United States Patent 12,264,328 (GENE EDITING COMPONENTS, SYSTEMS, AND METHODS OF USE) - sequence listing, part 2

SEQ ID NO: 318 - RNA, 36 nt, synthetic construct
  source 1..36: mol_type = other RNA
gtctaagacagcatttaaatttctactattgtagat

SEQ ID NO: 319 - RNA, 36 nt, synthetic construct
  source 1..36: mol_type = other RNA
ggctataagccttattaaatttctactattgtagat

SEQ ID NO: 320 - RNA, 36 nt, synthetic construct
  source 1..36: mol_type = other RNA
gtctaaatgacttttataatttctactattgtagat

SEQ ID NO: 321 - RNA, 36 nt, synthetic construct
  source 1..36: mol_type = other RNA
ggctactcgcctaattaaatttctactattgtagat

SEQ ID NO: 322 - RNA, 36 nt, synthetic construct
  source 1..36: mol_type = other RNA
gtctgaaagacacatataatttctactattgtagat

SEQ ID NO: 323 - RNA, 36 nt, synthetic construct
  source 1..36: mol_type = other RNA
ggctatagtaattttataatttctactattgtagat

SEQ ID NO: 324 - RNA, 36 nt, synthetic construct
  source 1..36: mol_type = other RNA
ggctatagtaattttataatttctactatcgtagat

SEQ ID NO: 325 - RNA, 36 nt, synthetic construct
  source 1..36: mol_type = other RNA
gtctaattgactttattaatttctactgttgtagat

SEQ ID NO: 326 - RNA, 36 nt, synthetic construct
  source 1..36: mol_type = other RNA
gtctataagactattataatttctactattgtagat

SEQ ID NO: 327 - RNA, 36 nt, synthetic construct
  source 1..36: mol_type = other RNA
gtctataggacttggataatttctactattgtagat

SEQ ID NO: 328 - RNA, 36 nt, synthetic construct
  source 1..36: mol_type = other RNA
ctctatgaggcacatttaatttctactattgtagat

SEQ ID NO: 329 - RNA, 36 nt, synthetic construct
  source 1..36: mol_type = other RNA
gtctataagacttaagtaatttctacttttgtagat

SEQ ID NO: 330 - RNA, 36 nt, synthetic construct
  source 1..36: mol_type = other RNA
ggctataaagctgattaaatttctactattgtagat

SEQ ID NO: 331 - protein, 1355 aa, synthetic construct
LLFIIEFEEKIMKTIENFCGQKNGYSRSITLRNRLIPIGKTEENIEKLQLLDNDIKRSKAYVEVKSMIDDFHRAFIEEVLSKAKLEWGPLYDLFDLFQNEKDKHKKSKIKKELETIQGVMRKQIVKKFKDDDRFDKLFKKEILTEFVPTVIKADESGTISDKRAALDVFKGFATYFTGFHQNRQNMYSEEAKATAISNRIVNENFPKFYANVKVFECLQKEYPAIITETEEALSEILNGKKLADIFSADGFNSVLSQSGIDFYNTIIGGIAGEAGTQKLQGINEKINLARQQLPTEEKNKLKRKMSVLYKQILSDRSTASFIPIGFESSDEVYESVKQFKEQSLDNVISAAKELFEKSDYDLSQIYVPAKEVTDFSLKLFGNWSILHDGLFLIEKDNSKKTFTEKQIENLRKEIAKTDCSLADLQNAYERWAKENDVKAEKTVKNYFKIAELRADGKSREKTSVEILNKIESTFEKIDFEKRDNLIKEKETATPIKEFLDEVQNLYHYLKLVDYRGEEQKDTDFYSKYDEILQTLSEIVPLYNKVRNFVTKKPNEVKKVKLNFDNVSLAKGWDVNKESDYTCILLRRSGLYYLGVLNPKDKPKFDSENNGETSINKNDCYEKLVYKYFKDVTTMIPKCSTQLNDVKQHFKNSNEDYILENNNFIKPLVISKRIFDLNNKTFDEKKMFQIDYYRNTGDLKGYTEAVKDWISFCMTFVHSYKSTCIYDFSSLGDCSQFKQVDQFYKEINLLLYKIWFVNVTAEKINSLVDSGKLFLFQIYNKDYSTGKDGGNGSTGKKNLHTMYWENLFSEENLRDVCLKLNGDAELFWRDANPDVKDVCHKKGSVLVNRTTSDGETIPEEIYQEIYKFKNPNKQEKSFKLSDTAKELLDSGKVGFKEAKFDIIKDRHFTQKTYLFHCPITMNFKAPEITGRKFNEKVQQVLKNNPDVKVIGLDRGERHLIYLSLINQKGEIELQKTLNLVEQVRNDKTVSVNYQEKLVQKEGERGKARKNWQTISNIKELKEGYLSNIVHEIAKLMVENNAIVVMEDLNFGFKRGRFAVERQVYQKFENMLIEKLNYLVFKDKKVAEPGGVLNAYQLTDKVANVSDVGKQCGWIFYIPAAYTSKIDPKTGFANLFYTAGLTNIEKKKDFFDKFDSIRYDRKTDSFVFTFDYSDFGDNADFKKKWELYSRGERLVFSKAEKSVVHVNPTENLKALFDKQGINWSSEDNIIDQIQAVQAERENCAFYDGLYRSFTAILQMRNSVPNSSKGEDDYLISPVMAEDGSFYDSREEAEKGKTTDGKWISKLPVDADANGAYHIALKGLYLLQNNFNLNENGYIENISNADWFKFVQEKEYAK

SEQ ID NO: 332 - protein, 1317 aa, synthetic construct
MVISYTFGGKKMKAVEKFCGQKNGYSRSITLRNRLIPIGKTEENIQKLKLLDKDMERAKAYDEVKKLIDEFHRTFIEEVLSKASFEWAPLYDQFDLFQTEKDKLKKNKIKKELEVLQGVMRKKIVESFKKDKRFEKLFKKELLTEFVPAVIKNDESGTITDKQAALNVFKGFATYFTGFHQNRQNMYSEEAQSTAISNRIVNENFPKFYANVKVFEYLKNNYPEIINETEKALEEFLNEKKLADIFSPENFNAVMSQSGIDFYNTVIGGIADEAGTKKLQGLNEKINLASQQLPSEEKYKLKKKMTILYKQILSDRNTASFIPVGFEKSEEVYESVKHFKEEILDKVITNTKKLFDSVDYDLGQIYVPAKEVTEFSLKLFGNWSIIHNGMFLLEQDMAKKVLSEKQIEALKKEIAKRDLSLSDLQNAYERWTKENDVKAEKNVRNYFKLTELRVDEKTKEKDSIEILKNLEVLYSKIDFEKQENLIQEKTSATPIKDYLDEIQNLYHYLKLVDYRGEEQKDTDFYSKYDEIIQTLSEIIPLYNKVRNFVTKKPNEIKKVKLNFDCPTLANGWDLNKESSNDAIILRKNGNYYLGIFNPKDKPKFEYNNEDSGYEKMIYKLLPGPNKMLPKVFFSAKGLETFRPPKDLVLGYEEGKHKKGDNFDKVFMHKLIDWFKYAINQHEDWKNFNFKFSPTEFYEDMSGFYKEVELQGYKITFNKVSDNCINSLVDSGKLFLFQIYNKDYSTGEEGGNGSTGKKNLHTLYWENLFSEENLRDVCFKLNGEAEFFWRDANPNVKAVCHKKDSVLVNRTTSDGKSIPEEIYQEIYKYKNPEKQEKEFTLSKDAKELLESGTVVCKKAKFTITKDRHFTQQTYLFHCPITMNFKAPEITGRKFNEHVQEILRNNPEVKVIGLDRGERHLIYLSLINQKGEIELQKTLNLVEQVRNDKTVSVNYQEKLVHKEVERDKARKSWQSISNIKELKEGYLSNIVHEIAKLMVENNAIVVMEDLNFGFKRGRFPVERQVYQKFENMLIEKLNYLVFKDKNVTEPGGVLNAYQLADKAVNVSDVGKQCGWIFYIPASYTSKIDPKTGFANLFYTAGLTNIEKKKDFFDKFDSIRYDRKLDSFVFGFDYSNLSDNADYNKKWELYSRGERLVYSKAEKSTISVNPTENLKVLFDKQGIVWDSKDNFIDQIHAVQAERDNVPFYDGLYRSFTAILQMRNSVPNSSKQEDDYLISPVMADDGNFYDSRLEAAKGKDEKGNWISKLPVDADANGAYHIALKGLYLLKNDFNLNEKGYIENISNADWFKFVQNKEYQDC

SEQ ID NO: 333 - protein, 1295 aa, synthetic construct
MKTIDSFCGQNEGYSRSITLRNKLIPIGETEKNIKEFLEKDVERSEAYPQIKKLIDDIHRGFIEECLSNVSFPWEPLFDQFELYQNEKEKIKKNAKKKELIVLQVAARKRIVKAFKDNKDFEKLFKEELFKELLPQLIKSAPVTEIADKEKALSVFTRFSTYFNGFHENRKNMYSEEEISTGIAYRIVNENFPKFFSNIKLFEYLKDNFPEIIKETEISLKDTLKGKKLCDIFKVEAFNNVLSQSGIDFYNTIISGVAGEGGTQKIKGMNEIINLAKQQLPKEEKDKLHGKMVVLFKQILSDRETASFIPTGFEKNEEVYASIKEFNNIIVKDSVTETRNLFALNSDIKLNEIIVPAKSITAFSLTIFGNWVIISEGLYLLEKDKITKALSEKQEEQLHKDIDKKDCNLEEIQSAYERWCSENGEIVRTSVRKYFNLIETQSSSSENTSTKKEVCILDEITKSFSQIDFENEKDLQQEKEAATPIKIYLDEVQNLYHHLKLVDYRGEEQKDSNFYSKFDEIIEKLSEIISIYNKVRNFVTKKPGEVKKVKLNFDCPTLANGWDENKEKDNDAILLLKDGNYYLGIYNPKNKPKFDFEESKASDCYKKVVYKLLPGPNKMLPKVFFSAKGQKEFLPPKELLLGYEEGKHKKGENFDKEFMYKLIDWFKDAINRHEDWKKFDFKFSDTRSYEDMSAFYKEVELQGYKISFKKVSTEIINEFVNSSKLFLFQIYNKDFAVKATGKKNLHTLYWENLFSEENLKDICFKLNGEAELFWRKASLIKEKVTVHKKNSILINRTKKDGSTIPENLYQEIYQYKNNMISDISENAKDLLNSGKVICKKATHDITKDKHFTEDAYLFHCPITMNFKAPEITGRKFNDKVLEALKENPEIKIIGLDRGERHLIYLSLINQKGEIELQKTLNLVDQIRNDKTVQINYQEKLVQNEGDRDKARKNWQTIGNIKELKEGYLSAIIHEIATLMIENNAIVVMEDLNFGFKHGRFAVERQVYQKFENMLIEKLNYLVFKDRSIKEPGGVLNAYQLTDKAANVSDVYKQCGWLFYIPAGYTSKIDPKTGFANLFVTKGLTNVEKKKDFFSKFDSIYYDEKEACFVFAFDYSKFGDNADFKKKWEVYTKGERLVYSKQERKSITVSPTEELKKIFNEFSINWNNSESVLDQIKTIPAEKLNAKFFDTLLRAFNATLQMRNSVPNSSRQEDDYLISPVKARDGTFYDSRIEAEKGIDKNGRWVSKLPVDADANGAYHIALKGLYLLENNFNRNEKGVIQNISNVEWFKFAQTK

SEQ ID NO: 334 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHDNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDCPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 335 - protein, 1307 aa, synthetic construct
MATIENFCGQENGYSRSITLRNKLIPIGKTANNLKQFLEKDQERADVYPEIKKLIDEIHRGFIEDTLSKFSFVWEPLFDDFELYQNEKDKSKKATKKKDLEKFQSGARKKIVEAFKKHPDYDKLFKDGLFKELLPALIKNSSDSEISNKEEALKVFDRFSTYFVGFHENRKNMYSEEDKSTAISYRIVNENFPKFYANVKLYNYIKENFPKIISETEESLKNHLNGKRLDEIFNAESFNDVLAQSGIDFYNTVIGGISTETEKVQGLNEKINLARQKLPAEEKNKLRGKMVVLFKQILSDRGTSSFIPVGFNNKEEVYSSVKSFNDEFVNISVCETKELFKQVAEFNLSEIYVPAKSLTNFSQNIFGSWSILTEGLFLLEKDKVKKALSENKEEKINKEIAKKDYSLDELQVAYERYCNEHNFSVEKNCKDYFDVVDYRSENEKSDKKKISILSAITESYSKIDFENIHDLQQEKEAATPIKTYLDEVQNLYHHLKLVDYRGEEQKDSNFYSKLDEIITQLSEIIPLYNKVRNFVTKKPGEMKKIKLNFDCPTLANGWDENKESSNDAIILRKDGKYYLGIFNPNNKPKFSKIENISESYYEKMVYKLLPGPNKMLPKVFFSTKGQETFLPPKDLLLGYDAGKHKKGDAFDKEFMYKLIDWFKDAINRHEDWKKFNFVFSPTKSYEDMSGFYREVELQGYKVSFQKISDTEINSFVSNGKLFLFQIYNKDFALKASGKKNLHTLYWENLFSEENLKDVCLKLNGEAELFWRKPSLNKEKVTVHEKGSILVNRTTNDGKSIPEDIYQEIYQFKNKMKDKISDNISIQNDDGKVITITVTLENKQKEKFTENYKVVYKTATHYITKDNRFTEDTYLFHCPITMNFKAPDKSNKEFNNHVLEVLSGNPNVKIIGLDRGERHLIYLSLINQKGEIELQKTLNLVEQVRNDKTVKVNYQEKLVHKEDDRDKARKSWQTIGNIKELKEGYLSNVVHEIAKMMVEHNAIVVMEDLNFGFKRGRFAVERQIYQKFENMLIEKLNYLVFKDKKVTEPGGVLNAYQLTNKSANVSDVYRQCGWLFYIPAAYTSKIDPKTGFANLFITKGLTNVEKKKEFFDKLDSIRYDSKEDCFVFGFDYGKICDNADFKKKWEVYTKGERLVYNKTERKNININPTEELKSIFDDFGINWNNEENFIDSVHTIQAEKSNAKFFDTLLRMFNATLQMRNSIPNTEIDYLISPVKSEDGTFFDSREELKKGENAKLPIDADANGAYHIALKGLYLLENDFNRNDKGVIQNISNADWFKFVQEKEYRD

SEQ ID NO: 336 - protein, 1298 aa, synthetic construct
MTTINKFCGQGNGYSRAITLRNKLIPIEKTADNLKQFLEKDQERADSYPEIKKLIDEVHRGFIEDTLTKFSFVWEPLFDDFELYQNEKDKSKKAAKKKDLEKFQSGARKKIVEAFKKHPDYDKLFKDGLFKELLPALIKNSSDSEISNKEEALKVFDRFSTYFVGFHENRKNMYSEEEKFTAISYRIVNENFPKFYANVKLYNYLKENFPQIISETEESLKNHLNEKKLDEIFNVESFNDVLAQSGIDFYNTVIGGISTETEKVQGLNEKINLARQKLPAEEKNKLRGKMVVLFKQILSDRGTSSFILVDFNNKEEVYSSVKSFNDEFVNLSVCETKELFKQVAEFNLSEIYVPAKSLTNFSQNIFGSWSILTEGLFLLEKDKMKKALSENQEEKINKEIAKKDYSLDELQVAYERYCNEHNFSVEKNCKDYFDVVDYRSENEKSDKKKVSILSAITESYSKIDFENIHDLQQEKEAATPIKTYLDEVQNLYHHLKLVDYRGEEQKDSNFYSKLDEIITQLSEIIPLYNKVRNFVTKKPGEMKKIKMMFDCSSLLGGWGTDYGTKEAHIFIDSGKYYLGIINEKLSKDDVELLKKSSERMVTKVIYDFQKPDNKNTPRLFIRSKGTNYAPAVSQYNLPIESIIDIYDRGLFKTEYRKINPEVYKESLIKMIDYFKLGFERHESYKHYPFCWKESSKYNDIGEFYKDVINSCYQLHFEKVNYDNLLKLVENNKIFLFQIYNKDFAEKKSGKKNLHTLYWENLFSEENLKDVCLKLNGEAELFWRKPSLNKEKVTVHKKGSILVNRTTNDGKSIPEDIYQEIYQFKNKMIDNLSENAKSLLDSGVVVCKEATHNITKDNRFTEDTYLFHCPITMNFKAPDKSNKEFNNQVLEVLSDNPDVKIIGLDRGERHLIYLSLINQKGEIELQKTLNLVDQVRNDKTVKVNYQEKLVHKEGDRDKARKNWQTIGNIKELKEGYLSNVVHEIAKMMVEHNAIVVMEDLNFGFKRGRFAVERQIYQKFENMLIEKLNYLVFKDKKVTEPGGVLNAYQLTNKSANVSDVYRQCGWLFYIPAAYTSKIDPKTGFANLFITKGLTNVEKKKEFFDKFDSIRYDSKEDCFVFGFDYGKICDNADFKKKWEVYTKGERLVYNKTERKNISINPTEELKSIFDDFGINWNNEDNFIDSVHTIQAEKSNAKFFDTLLRMFNATLQMRNSIPNTEIDYLISPVKSEDGTFFDSREELKKGENAKLPIDADANGAYHIALKGLYLLENDFNRNDKGVIQNISNADWFKFVQGKEYEK

SEQ ID NO: 337 - skipped

SEQ ID NO: 338 - DNA, 3954 bp, synthetic construct
  source 1..3954: mol_type = other DNA
atggtgattagctacacatttgggggcaagaaaatgaaggctgtggagaaattttgcggccagaaaaatggatacagtcggtcgattactctgcgtaataggctgatccctattgggaaaaccgaagagaacattcaaaaactcaagctcctcgataaagatatggagcgcgctaaggcttatgacgaagtcaagaaactcatagatgagttccacaggacatttattgaagaagtcctttcaaaggcttcctttgagtgggcaccactttacgaccagtttgatctgtttcaaaccgagaaggataagctgaagaagaacaagatcaagaaagagctggaagtgctccaaggggtgatgaggaagaaaatcgtagagtctttcaagaaggataaaaggttcgaaaaactgttcaagaaggagttgctgacagagttcgttcctgcagtcattaagaatgacgaatctggtacaattacagataagcaggccgcactaaatgtcttcaaagggtttgcgacctattttacagggtttcaccagaatcggcagaacatgtatagcgaagaggcccagtctaccgcgatctctaatcggattgtgaatgagaacttccctaagttttacgccaacgtgaaggtcttcgagtaccttaaaaataactacccagagatcataaacgagacagaaaaggcacttgaggagttcctaaatgaaaagaaactggctgatatcttcagtcccgagaactttaacgccgtgatgtcccagtcaggcatagacttctataacaccgtgattgggggtattgcggatgaagctggcaccaagaagctccaaggtttgaacgaaaaaattaatctggcctcccagcagttaccgagcgaggagaagtacaagctaaagaagaaaatgacgattctgtacaaacagattctttccgaccgaaatacagcttcattcatacccgtaggtttcgaaaaaagtgaagaagtatatgagagcgtcaaacatttcaaagaggagattctggacaaggtgattaccaacaccaagaaattgttcgactcagtggattatgatctgggccaaatctatgttcctgcaaaggaagtaaccgagttttcccttaagctgtttggaaactggtctatcatacataatgggatgtttctgttggagcaggatatggccaaaaaagtattgtcagaaaaacagatcgaggcactcaaaaaggaaattgccaaacgcgaccttagcttatcagatttgcagaatgcttacgaaaggtggactaaggaaaacgatgttaaagctgaaaagaacgtgcggaattattttaagctgactgagctgcgcgtggacgagaaaacaaaggaaaaagatagcatcgagatcttgaagaatctggaagtactttacagtaagatcgattttgagaagcaggagaatctaatacaggagaagacttcagccactcctattaaagactatctggacgagatccagaacttataccactatctgaagttagttgactatagaggagaagagcagaaagacacagacttctatagcaagtacgacgaaataatccaaacactgagtgagattatcccgctctataataaggtgagaaacttcgtgacaaagaagcccaacgaaatcaaaaaggttaagctgaacttcgactgcccaactcttgccaatggatgggatctcaacaaagagtcatctaacgacgccattatcttgcgcaagaatggtaactactacctgggcattttcaatccaaaggacaaaccaaagtttgagtacaataatgaagactctggatatgagaagatgatctacaagctgctgcccggccccaataagatgctgccaaaggtgttttttagcgcgaaagggctggagacgtttcggccccccaaggatctggtcctaggctacgaggaaggaaaacataaaaagggtgacaatttcgacaaggtctttatgcataaactgatagactggtttaagtacgcaataaatcagcacgaggactggaaaaactttaacttcaaattcagccctactgagttctacgaggatatgtcgggcttttacaaagaagtggagttgcagggctacaaaatcacgttcaacaaggtgagtgataattgcatcaattccctcgtcgacagtggaaaactgtttctgtttcagatctacaacaaggattattccacgggggaagaaggcggcaacggatccactggcaagaagaatctgcataccctttactgggaaaatctcttttccgaagaaaatttgcgagatgtgtgctttaaactgaatggtgaggccgaattcttttggagagacgctaatcctaatgtcaaagcggtgtgtcacaaaaaagactctgtgctcgtcaacaggaccacctccgacgggaagtctattccagaggaaatttaccaggagatctacaagtacaagaacccagagaagcaagagaaggagttcaccctttccaaagatgctaaagagctcctggagtctgggacagtggtgtgtaagaaagctaaattcaccattacgaaagatcggcattttacccagcaaacctatttattccattgccctatcacaatgaacttcaaggcccccgagatcactggacgcaaatttaatgagcacgtccaggagatcctccgcaataatccagaagtaaaggtgattggactagacagaggcgaaagacatctgatctatttgtcgctcatcaatcagaaaggggaaatcgagcttcaaaagaccctcaatctggtggagcaggtgcgaaacgataagactgtgagtgttaactaccaggagaagctggtgcacaaagaagtggagcgagataaagcccggaagtcctggcagtcaatctcgaacatcaaggaacttaaagaggggtacttgagcaatattgtgcacgagatcgccaagttgatggtggaaaacaatgcaattgttgtaatggaagatctcaacttcggttttaagcgtggccgatttcccgtcgaaaggcaggtttaccaaaaattcgagaacatgctaatagaaaagctaaactacctggtattcaaggacaaaaacgtgacggaaccgggtggcgttttaaacgcctatcagctcgctgacaaagccgttaacgtcagcgacgtgggaaagcaatgtggctggattttttatatacctgccagctatactagtaagatcgatccaaagactggattcgcaaatctgttctataccgcggggctgactaatatcgaaaagaagaaggatttcttcgacaaatttgacagtatcaggtacgacagaaaattagatagctttgttttcggattcgattactctaacttatccgacaacgccgactacaataagaaatgggagctctacagtcggggagagcgccttgtctattccaaagctgagaaaagcacaatctccgttaacccgaccgagaatctgaaggtgctgttcgataaacagggcattgtgtgggactctaaggacaactttatcgatcagattcacgcagttcaggctgagagagataacgtccccttctatgacggactttataggtccttcactgccatactgcaaatgagaaactctgtccctaactcatctaaacaggaagacgattacctcatctcacccgtgatggccgatgacgggaatttttatgatagccgtctggaggccgcaaagggcaaagacgagaagggcaactggataagcaagctgcccgttgacgctgacgccaacggtgcataccacatcgccttaaagggcctctatttgctcaagaatgatttcaacctgaacgaaaaagggtatatcgaaaacataagcaatgcagattggttcaaattcgtccaaaacaaagagtatcaggactgttga

SEQ ID NO: 339-342 - skipped (4 entries)

SEQ ID NO: 343 - DNA, 36 bp, synthetic construct
  source 1..36: mol_type = other DNA
atctacaacagtagaaatttagtatgaagttcaaac

SEQ ID NO: 344 - DNA, 34 bp, synthetic construct
  source 1..34: mol_type = other DNA
ctacaacagtagaaatttagtatgaagttcaaac

SEQ ID NO: 345 - DNA, 36 bp, synthetic construct
  source 1..36: mol_type = other DNA
atctacaacagtagaaattctatattagtttgaaac

SEQ ID NO: 346 - DNA, 35 bp, synthetic construct
  source 1..35: mol_type = other DNA
tctacaacagtagaaattctatattagtttgaaac

SEQ ID NO: 347 - DNA, 36 bp, synthetic construct
  source 1..36: mol_type = other DNA
gtttcaaactaattaagaatttctactgttgtagat

SEQ ID NO: 348 - DNA, 35 bp, synthetic construct
  source 1..35: mol_type = other DNA
tttcaaactaattaagaatttctactgttgtagat

SEQ ID NO: 349 - DNA, 36 bp, synthetic construct
  source 1..36: mol_type = other DNA
gtttcagtctgatattgaatttctactgttgtagat

SEQ ID NO: 350 - DNA, 35 bp, synthetic construct
  source 1..35: mol_type = other DNA
tttcagtctgatattgaatttctactgttgtagat

SEQ ID NO: 351 - DNA, 36 bp, synthetic construct
  source 1..36: mol_type = other DNA
gtttgaacttcttattaaatttctactgttgtagat

SEQ ID NO: 352 - DNA, 35 bp, synthetic construct
  source 1..35: mol_type = other DNA
tttgaacttcttattaaatttctactgttgtagat

SEQ ID NO: 353 - DNA, 36 bp, synthetic construct
  source 1..36: mol_type = other DNA
gtttaaacgaactattaaatttctactgttgtagat

SEQ ID NO: 354 - DNA, 35 bp, synthetic construct
  source 1..35: mol_type = other DNA
tttaaacgaactattaaatttctactgttgtagat

SEQ ID NO: 355 - RNA, 36 nt, synthetic construct
  source 1..36: mol_type = other RNA
gtttgaacttcatactaaatttctactgttgtagat

SEQ ID NO: 356 - RNA, 36 nt, synthetic construct
  source 1..36: mol_type = other RNA
gtttcaaactaatatagaatttctactgttgtagat

SEQ ID NO: 357 - RNA, 36 nt, synthetic construct
  source 1..36: mol_type = other RNA
gtttcaaactaattaagaatttctactgttgtagat

SEQ ID NO: 358 - RNA, 36 nt, synthetic construct
  source 1..36: mol_type = other RNA
gtttcagtctgatattgaatttctactgttgtagat

SEQ ID NO: 359 - RNA, 36 nt, synthetic construct
  source 1..36: mol_type = other RNA
gtttgaacttcttattaaatttctactgttgtagat

SEQ ID NO: 360 - RNA, 36 nt, synthetic construct
  source 1..36: mol_type = other RNA
gtttaaacgaactattaaatttctactgttgtagat

SEQ ID NO: 361 - protein, 1396 aa, synthetic construct
  VARIANT 47: note = X is independently selected from any naturally occurring amino acid or absent
  VARIANT 48: note = X is independently selected from any naturally occurring amino acid or absent
  VARIANT 455: note = X is independently selected from any naturally occurring amino acid or absent
  VARIANT 456: note = X is independently selected from any naturally occurring amino acid or absent
  VARIANT 603: note = X is independently selected from any naturally occurring amino acid or absent
  VARIANT 614..618: note = X is independently selected from any naturally occurring amino acid or absent
  VARIANT 634..636: note = X is independently selected from any naturally occurring amino acid or absent
  VARIANT 646..654: note = X is independently selected from any naturally occurring amino acid or absent
  VARIANT 665..671: note = X is independently selected from any naturally occurring amino acid or absent
  VARIANT 679..692: note = X is independently selected from any naturally occurring amino acid or absent
  VARIANT 703..707: note = X is independently selected from any naturally occurring amino acid or absent
  VARIANT 732..735: note = X is independently selected from any naturally occurring amino acid or absent
  VARIANT 740..742: note = X is independently selected from any naturally occurring amino acid or absent
  VARIANT 746: note = X is independently selected from any naturally occurring amino acid or absent
  VARIANT 803..808: note = X is independently selected from any naturally occurring amino acid or absent
  VARIANT 894..897: note = X is independently selected from any naturally occurring amino acid or absent
  VARIANT 910..930: note = X is independently selected from any naturally occurring amino acid or absent
  VARIANT 1306: note = X is independently selected from any naturally occurring amino acid or absent
  VARIANT 1307: note = X is independently selected from any naturally occurring amino acid or absent
  VARIANT 1336: note = X is independently selected from any naturally occurring amino acid or absent
  VARIANT 1337: note = X is independently selected from any naturally occurring amino acid or absent
  VARIANT 1339: note = X is independently selected from any naturally occurring amino acid or absent
  VARIANT 1341: note = X is independently selected from any naturally occurring amino acid or absent
XXXXXXFXXKXMKTIEXFCGQKNGYSRSITLRNXLIPIGKTEENJKXXQFLEKDQERAXAYPEIKKLIDEIHRGFIEXTLSKXSFXWEPLFDXFELYQNEKDKSKKAAXKKXLEKLQSGARKKIVEAFKKXPDFXKLFKXXLFKELLPALIKNXXXXEISDKEXALKVFXRFSTYFTGFHENRKNMYSEEAKSTAISYRIVNENFPKFYANVKLFXYLKENFPEIISETEESLKXHLNGKKLDDIFSXEXFNXVLXQSGIDFYNTVIGGIXGEAGTXKXQGLNEKINLARQQLPXEEKNKLRGKMVVLFKQILSDRXTXSFIPVGFENKEEVYSSVKXFNXEIVBKSVXETKELFXQVXXFBLSEIYVPAKSLTBFSXXIFGXWSILXEGLFLLEKDKMKKALSEKQEEKJNKEIAKKDCSLDELQXAYERXCXEXNXXVEKNXKDYFDXVXYRXXSXXXKSEKKKVSILSXITESXSKIDFENIHDLQQEKEAATPIKTYLDEVQNLYHHLKLVDYRGEEQKDSNFYSKXDEIITXLSEIIPLYNKVRNFVTKKPGEXKKXKLNFDCPTLANGWDENKESSNDAIILRKDGKYYLGIXNPKXNKPKFXKEXXXXXXXISXDCYEKMVYKLLPXXXGPNKMLPKVXXXXXXXXXFFSAKGQEXFXXXXXXXLPPKDLJXXXXXXXXXXXXXXLGYDEGKHKKXXXXXGDXFDKEFMXKLIDWFKDAINRHEXXXXDXKKXXXXNFXXFSDTSSYEDMSGFYKEVELQGYKISFXKVSDEEINSLVDSGKLFLFQIYNKDFATXXXXXXKATGKKNLHTLYWENLFSEENLKDVCLKLNGEAELFWRKASLNKEKVTVHKKGSILVNRTTXDGKSIPEXIYQEIYQFKNKMKDEXXXXJSDNAKELLDSGXXXXXXXXXXXXXXXXXXXXXKVVCKXATHDITKDXHFTEDTYLFHCPITMNFKAPXITXXXFNNHVLEVLXNNPDVKXIGLDRGERHLIYLSLINQKGEIELQKTLNLVEQVRNDKTVSVNYQEKLVHKEGDRDKARKNWQTIGNIKELKEGYLSNXVHEIAKLMVEXNAIVVMEDLNFGFKRGRFAVERQXYQKFENMLIEKLNYLVFKDKKVTEPGGVLNAYQLTBKSANVSDVYKQCGWLFYIPAAYTSKIDPKTGFANLFITKGLTNVEKKKXFFDKFDSIRYDXKEDCFVFGFDYSKICDNADFKKKWEVYTXGERLVYXKTERKNISVNPTEELKSIFDXFGINWNNEXNFIDXIHTIQAEKSNAKFFDTLLRMFNATLQMRNSVPNXXXXEDDYLISPVKAEDGTFXDSREEAKKGXDXXXXXXXKLPXDADANGAYHIALKGLYLLENDFNRNEKGVIQNISNADWFKFVQEKEYXDC

SEQ ID NO: 362 - DNA, 4068 bp, synthetic construct
  source 1..4068: mol_type = other DNA
ttgttgtttataattgagtttgaggagaaaattatgaaaacaattgaaaatttttgtggccaaaaaaatggttattctcgctctattaccttgcgaaacaggttgattccaatcggaaaaacagaagaaaatattgaaaaactacaacttcttgataatgacattaagcgttcaaaggcttatgttgaagtcaagtcgatgatagatgattttcaccgcgcattcatagaagaagttctttctaaggcaaaacttgaatgggggccattatatgacctgtttgatttgttccagaatgaaaaagacaagcataagaaaagtaaaataaaaaaagagttagaaaccattcaaggtgtgatgcgaaaacagattgtaaaaaagtttaaggatgatgataggtttgacaagcttttcaagaaagaaattttaactgaatttgttccaactgtaataaaggctgatgaatcaggaactatatccgacaagcgggcagctcttgatgtgtttaagggatttgcgacatattttacaggttttcaccaaaacagacaaaatatgtatagcgaagaggctaaggctaccgctatcagcaatagaatagttaatgaaaattttccaaagttctatgcaaatgtaaaggtttttgaatgcttgcagaaagagtatcctgcaattatcactgaaacggaagaggctctttctgaaatccttaatggcaaaaaactggctgatatttttagcgcggacggatttaattcagttttgagccagagcggcattgatttttataatacgataattggcggcattgcaggagaggcaggaactcaaaagttgcaaggcataaacgaaaaaataaatcttgcccgccagcagcttcctacagaagaaaaaaacaagctcaagcggaagatgagtgtattatacaagcagattttaagcgacagaagtacggcttcttttattccgattggatttgaatcaagcgatgaagtttacgaatctgtaaaacagtttaaggaacagtcattagataatgtcatttccgctgcaaaagaattgtttgaaaaatctgattatgatttgagtcagatttatgttcctgcaaaagaagtcaccgacttttcattgaagctttttggcaattggtcgattttgcatgacgggcttttcttaattgagaaagataattcaaagaagactttcacggaaaagcagattgaaaacctaagaaaagaaatcgcaaaaacagattgttctcttgcggatttgcagaacgcctatgagcgatgggcaaaagaaaatgatgttaaagctgaaaagactgtaaagaactatttcaaaattgcagagcttcgcgctgatggaaaatcaagagaaaaaacttctgtggagattctgaataaaattgaatcgacctttgagaaaattgattttgaaaagcgagataatcttataaaggaaaaggagacggcaactccgataaaagaattcctcgacgaagttcagaacctttatcattatctgaaattggttgactatcgtggtgaagaacagaaggacaccgatttttattcaaaatatgatgaaatactgcagacgctttctgaaattgttccgctttataataaggtgagaaattttgtcacaaaaaagcctaatgaggtgaagaaagtaaagctgaattttgataatgtttcattagcaaaaggttgggatgtaaacaaagaatctgattatacatgtattttactccgcagaagtggactgtattatttaggagtactaaatccaaaagataagccaaagtttgactctgagaacaatggtgaaacaagtataaataagaatgattgttacgaaaagcttgtttataagtattttaaggatgtaacaaccatgattccaaaatgttcgacacagttaaatgatgttaaacagcattttaaaaactctaatgaagattatattttggaaaacaataattttattaagccacttgtaatttcaaagagaatttttgatctgaataataaaacttttgatgaaaagaaaatgtttcaaattgactattataggaatactggcgatttaaaaggttatacagaagctgtaaaagattggatttcattttgtatgacctttgttcattcctataaaagtacctgtatatatgatttttcttccttaggcgattgcagccaatttaagcaggttgatcagttttacaaagagattaatcttttactttataaaatttggtttgtgaatgtaactgctgaaaaaatcaattcccttgtagattccggtaaacttttccttttccaaatctacaacaaagactattcaactggtaaagacggcggaaacggttcaacaggcaaaaagaatcttcatacgatgtattgggaaaatttgttcagcgaagaaaatcttcgggatgtctgccttaaattgaatggagatgcagaacttttctggcgggatgcaaatcctgatgtgaaagatgtatgccataaaaaaggttcagttcttgtaaacagaacgacctctgacggtgagacaatcccagaagaaatatatcaagaaatttacaagttcaaaaatcctaataaacaggaaaaaagctttaaactttctgataccgcaaaagaacttctggatagtggaaaagtcggtttcaaagaggccaaatttgacattatcaaagaccgtcattttacacagaaaacatatctgttccattgtccgattaccatgaattttaaggctcctgaaattacaggaagaaaattcaatgaaaaagtccagcaggtgttgaaaaataatcctgatgtaaaggttattggtcttgaccgtggcgagcgtcatttgatttatctttcgcttatcaatcaaaagggcgaaatcgagcttcagaaaacgctcaaccttgtggaacaggttcgcaatgataaaactgtttctgtaaattatcaggagaaactagtccagaaggagggagagcgtggcaaggctcgcaagaactggcaaacaatcagcaatatcaaagaattaaaagaaggatatctttcaaacattgttcacgagattgcaaaattaatggtagaaaataatgcaattgtcgtaatggaagatttgaattttggatttaaacgaggacgatttgcggttgagcgtcaagtttaccagaagtttgaaaacatgctcattgaaaagcttaattatcttgtgttcaaggataagaaagtcgctgagcctggtggcgttttgaatgcatatcagctaactgacaaagttgcaaatgtaagcgatgttggcaaacagtgcggatggattttctatattccggctgcgtatacttcaaaaattgatccaaagactggttttgcaaatcttttttatactgcagggcttacaaatatcgaaaagaaaaaagatttctttgataagtttgattctattcgctatgacagaaaaacagattcgtttgtgttcacttttgattacagcgactttggagataatgcggactttaagaaaaaatgggaactctattctaggggagagcgacttgttttcagcaaggcagagaaatctgttgttcatgtaaatccaacagaaaacttaaaggcattgttcgacaagcaagggataaactggagttcagaagataatattatagaccagatacaggcagtgcaggctgaaagagaaaattgcgctttttatgacggcctataccgttcgtttactgcaattctccagatgcgaaattccgttcctaattcttcaaaaggggaagatgattatctgatttcaccagtcatggcagaagatggaagtttctatgacagccgagaggaagctgaaaaaggaaaaacgactgacggaaaatggatttcaaagcttcctgttgatgctgatgccaacggcgcgtaccatattgcgctaaagggactttatcttttgcagaataatttcaatttaaatgaaaatggctatattgaaaacatttcaaacgccgactggtttaagtttgttcaggagaaggaatatgcaaaataa

SEQ ID NO: 363 - skipped

SEQ ID NO: 364 - DNA, 3888 bp, synthetic construct
  source 1..3888: mol_type = other DNA
atgaaaactattgattctttttgtggacaaaacgagggttattcacgttcaataacattacgaaataaattgattccaattggagaaactgaaaaaaatattaaagagtttttagaaaaagatgttgaacgatcagaagcttatcctcaaataaagaaattaatagatgatatacatagaggatttatagaagagtgtctttctaatgtttcttttccatgggaaccattatttgatcagtttgagttatatcaaaatgaaaaagaaaagataaaaaagaatgcgaagaaaaaagaacttattgttcttcaagtggcagcacgaaaacgaattgtaaaagcatttaaagataataaggattttgaaaagctttttaaggaagaattatttaaggaattattgcctcaattaataaaatctgctcctgttacagaaattgcagataaagaaaaagcactttctgtttttacaagattcagtacatattttaatggttttcatgaaaataggaaaaatatgtatagtgaagaggaaatatcaacaggaattgcatatagaatagtaaacgaaaattttccaaagtttttttcgaacataaaactttttgaatatttaaaagacaactttccagaaattataaaagaaacagagatttcattaaaagacacattaaaaggcaaaaagctttgtgatatttttaaagttgaagcttttaataatgttttatctcagagtggaatagatttttataatacgataattagtggtgttgctggtgaaggtggcacacagaaaattaagggaatgaatgaaataatcaatcttgcaaaacaacaacttccaaaggaagaaaaagataagttacatggcaagatggttgtattattcaaacagattttgagtgatagagagactgcatcatttataccgactggatttgaaaaaaatgaagaagtatatgcttctataaaagagtttaacaatattattgtaaaagattctgttacagaaacaaggaatttgtttgctctaaatagtgatattaagctcaatgaaataattgtgccagcaaaatctattacagcattttctctaacaatatttggaaattgggtaattatttctgaaggtttgtacctattggaaaaagataaaataactaaagctttatcagaaaagcaagaggaacagcttcataaagacattgataaaaaggactgtaatcttgaagaaattcaaagtgcatacgaacgatggtgtagcgagaatggggaaattgttcgtacatctgtaagaaaatattttaatcttattgagacacaatcaagttcatctgaaaacacatcaaccaagaaagaagtgtgcattcttgacgaaataacaaagtctttttctcaaatagattttgaaaatgaaaaagatttacagcaggaaaaagaagcggcaactccaataaaaatatatttagatgaagtacagaatctttatcatcatcttaagcttgttgattatcgtggagaagaacaaaaagattccaatttctattctaaatttgatgaaataatagaaaagctttcagaaattatttctatatataataaggttcgcaattttgtcacaaagaaaccaggagaagtaaaaaaggtaaagcttaattttgattgtccaactcttgctaatggctgggatgaaaataaagagaaggataatgatgcgattcttcttttaaaagatggaaactattatttaggaatttataatccaaaaaataaaccaaaatttgattttgaagaaagcaaagcttctgattgttataaaaaagttgtatataaacttttaccaggaccgaataaaatgcttccaaaagtatttttctcagcgaaaggacagaaagagtttcttccaccaaaagaattgcttttaggatacgaagaaggtaagcataagaaaggagagaattttgataaggaattcatgtataaactgattgattggtttaaggatgcaattaacagacatgaagactggaaaaaatttgattttaaattttcagatacaagaagttatgaagatatgagcgcattttataaagaagtcgaattacagggatataagatttcttttaaaaaggtatctacagaaatcataaatgaatttgtaaatagcagtaaactttttctttttcaaatttataataaagattttgcagtaaaagccactggaaaaaagaatcttcatactctttattgggaaaatttatttagtgaagaaaaccttaaagatatttgcttcaaacttaatggagaagcagaacttttctggcgaaaggcaagtttaatcaaagaaaaagttacggttcataaaaagaattcaattcttataaatcgaacaaaaaaagatggctcaacaattccagaaaatctttatcaggaaatctatcaatataagaataatatgattagtgatatttctgagaatgcgaaagatttactaaattctggaaaagtaatttgtaaaaaagcaacacacgatattacaaaagataaacattttacagaagatgcatatctttttcattgtccaattacaatgaattttaaagctcctgagattacaggtagaaagtttaatgataaagtgcttgaagcacttaaagaaaatcctgaaataaagattattggattggatcgtggtgaaaggcatttgatttatttatctctaattaatcaaaaaggagaaattgaattacaaaaaactctgaatcttgtagaccaaattagaaatgataaaactgtacaaattaattatcaagaaaaattagttcaaaatgagggagatcgagataaagctagaaagaattggcagactataggaaatataaaagaacttaaagaaggctatctttcagctataatacatgaaattgctacattgatgatagaaaacaatgccattgttgttatggaagatttgaactttggttttaagcatggaagatttgctgttgaacgacaagtatatcaaaagtttgaaaatatgcttattgaaaaattgaactatcttgtatttaaagatcgttctataaaagaaccgggtggagttcttaatgcatatcagctcacagataaagctgctaatgtttctgatgtttataaacaatgtggttggcttttctatattcctgcaggatatacttcaaaaatagatccaaaaacaggttttgctaatctatttgtaactaaaggattaacaaatgtagaaaagaagaaggatttcttttcaaagtttgattcaatttattatgatgaaaaagaagcttgttttgtttttgcttttgattatagcaaatttggtgacaatgcagactttaagaaaaaatgggaagtttatacgaaaggtgaaagacttgtttatagtaaacaagaaagaaagtctattactgtaagtccaactgaagaacttaaaaaaatatttaatgagtttagtataaactggaataatagtgaaagtgttcttgaccaaataaaaactattcctgctgaaaaattgaatgctaagttttttgatacattattacgtgcatttaatgctactttgcaaatgcgtaattctgtaccaaattcttcacgacaggaagatgattatttaatatctcctgtaaaagcaagagatggaactttctacgatagtcgcattgaagctgaaaagggaatagataaaaatggcaggtgggtttctaaattaccagttgatgccgatgcaaatggagcttatcatattgcacttaaaggattatatcttttggaaaacaattttaatcgaaacgaaaaaggagttatccaaaatatttctaatgtagaatggttcaagtttgcacagacaaaataa

SEQ ID NO: 365 - DNA, 3882 bp, synthetic construct
  source 1..3882: mol_type = other DNA
atggctagaataattgatgagttttgtggacagatgaatgggtattctcgttcaattactttgaggaataggttagttcctattgggaaaactgaagaaaatttaaagcagtttttagaaaaagatttggaaagagcaactgcttatccggacataaaaaatcttatagatgctattcatcgtaatgtaattgaggatactttatccaaagttgctttgaattggaatgaaatattcaatatacttgctacttaccaaaatgaaaaagataaaaaaaagaaagcagcaataaaaaaggatttagagaaattacaaagtggtgcaagaaaaaaaatagttgaggcttttaaaaagaatcctgattttgaaaaattgtttaaggaaggattgttcaaagaacttttacccgaattaatcaaatctgctcccgttgacgaaatagcagtcaaaacaaaagctttggagtgttttaatagatttagtacatattttacaggctttcatgacaacagaaaaaatatgtatagtgaagaggcaaagtctacggcaataagttatcgtatcgtaaatgaaaatttcccaaaattttttgcaaatataaaactgttcaattatttaaaagagcattttccaagaataattattgatacagaggaatctttaaaagattacctcaaaggtaaaaaacttgactctgtgttcagtattgatggttttaacagtgtactggctcaaagtggaattgatttttataacacagtaattggtggaatttctggtgaagcaggaacaaaaaaaactcagggattgaatgaaaaaatcaatcttgcaagacaacaattgtcgaaagaagaaaaaaataaacttcgtggtaaaatggttgtcttgtttaaacagattttaagtgatagagaaacctcttcttttattccagttggttttgcaaataaagaggaggtttattcaactgttaaggaatttaataactcaattgctgaaaaggctgtttcaaaagtaagagacttattcttacacagagaagaatttactcttaatgaaatcttcgttcctgcaaagtcattgacagatttttctcaagcgatttttgggtcttggtcaatactttctgaaggtctgttcttgctggaaaaagatagcatgaaaaaggctttatctgagagtcaagaagaaaaaatcaataaggaaattgcgaaaaaagattgttcttttacagaattgcagttggcttatgaaagatattgtactgaacataatctacctgtagagaaattttgcaaggattattttgacattgtagattatcgtggaaatggtgcaaaatcagaaaagacaaaagtttctattctttctgaaattttggagacatttttgcaacttgattttgaccatattcaggatttacaacaagaaaaaaatgcggcaattcctataaaagcctatttagatgaagtacagaatctatatcaccatttgaaattggtagattatcgtggtgaggaacaaaaggattcaactttttattctaaacatgatgagattttgactgatctttcgcaaatcgttcccctttataataaagttagaaactttgttaccaagaaacttggagaaagtaaaaagataaaacttaattttgattgtccaactttagcaaatggctgggatgaaaaccaagagtcttctaatgatgccattatcttgagaaaagatgggaaatattatcttggaatttataatccaaataacaagccaaaatttgctaagaaagatagcattgttggtgattgttatgaaaaaatggcttataaacaaatagcacttccaatgggattaggtgcattcgtaaggaaatgttttggtaccgctcaaaagtatggctggggttgtccagaaaattgcttaaattctgaaggaaaaattataatcaaagatgaggaagcaaaaggaaatttagaggcaattatcgattgttataaagacttcttaaataaatatgaaaaagatggttttaaatacaaagattacaatttcagctttttagattctgcttcttatgaaaaattatctgacttttttaacgatgtaaaacctcaaggttataaactctccttcacaagtattccattatcagaaattgataaaatgatagatgaaggcaagctcttccttttccagatttacaacaaggactttgcgaagaaagcgacagggaagaaaaatcttcataccttgtactgggagaatctttttagtgttgagaacttgcaggatgtggtcttgaaattgaatggcgaggcggaactcttttggagggaggcaagcatcaaaaaggataaggtcattgtccacaagaaaggttctattctggtgaataggacgactacagacggaaaatctattccagaggccatctatcaggaaatttatcaacttaagaacaagatggctgactccatttctgatgaagccaaaaggttgttggagtcaggaactgtcgtttgtaaggttgccacccatgatatcgtgaaggacaagcacttcacagagaatacctatctgttccactgtcctattaccatgaatttcaaggcgaaggatagaacaaataaggaatttaataatcatgtcttggaggttctcaataagaatccagacataaaagtcattggcttggatcgtggagagcgtcatttgctctatctttctttgatcaaccaaaaaggtgagattgaatgccagaaaacactgaatttggtggagcaagtgaggaatgacaagactgtctctgtaaactaccatgaaaagctggtccacaaagagggtagtcgtgatgcagcacgaaagaattggcaaacgattgggaatataaaggaattgaaggaggggtatctttccgctgtagtccatgagattgccagcttgatggtgaagcataatgcaatcgttgttatggaggatttaaacttcgggttcaagcggggacgttttgcagttgagcgtcagatttatcagaagtttgagaatatgctgatagaaaagctgaattatcttgttttcaaagataggaaggtcactgagccgggcggagtattgaatgcctatcaattggcgaataagtctgcaaaggtgacggacgtttacaagcaatgtggatggcttttctacatccccgcagcctacacctccaagattgaccctcggactggatttgccaatctttttatcacaaaggggctgacaaatgtggaaaagaagaaggaattctttggaaagtttgattcaatcagatatgatgccacggagtcatgctttgtctttagctttgattacgcaaaaatctgtgacaatgcagactacaagaaaaaatgggatgtgtacacgaggggaacccggcttgtgtacaataaaactgaacggaagaatgtttctgtcaatcccacagaagagttgcagtgtgtatttgatgaatttggaatcaagtggaatactggagaggacttgattgaatccatcagtttgattccggcagaaaagtcgaatgcaaaattctttgacgttctgttgaggatgttcaatgccacactgcaaatgaggaattctgtgccgaatacggacactgactacttggtttctcctgtgaaagcggaggacggttctttctttgattctcgtgaggagtttaagaaaggtggagatgcaaggcttcccattgactgtgatgccaatggagcgtatcacattgcgttgaagggtctgtatttgctgttgaatgacttcaatcgggataacaagggagtgattcagaatatctccaacaaggattggttcaagtttgtacaggagaaagtatacaaggactga

SEQ ID NO: 366 - DNA, 3924 bp, synthetic construct
  source 1..3924: mol_type = other DNA
atggcaacgattgagaatttttgtggacaagagaatgggtattctcggtcaattactttaagaaataagttgattcctattggaaaaacagcgaacaacttaaaacaatttttggaaaaggatcaagaaagagctgatgtttatcctgaaattaaaaagttaattgatgaaatacatagaggctttattgaagatactctttctaagttttcatttgtatgggaacctttatttgatgattttgaattatatcaaaatgaaaaggataaatctaaaaaagccacaaagaaaaaagatttagagaaatttcaaagtggagcaagaaaaaaaattgtggaagcgtttaagaagcatccagactatgacaaactttttaaagatggattatttaaggaattattaccagctttgataaaaaattcttctgattctgaaatatcaaataaagaagaagcattaaaagtttttgatagatttagtacatattttgttggttttcacgaaaatagaaaaaatatgtatagcgaagaagacaaatctactgcaataagctatagaatagttaatgaaaactttccaaaattctatgccaatgtaaaattgtacaattatataaaagaaaatttcccaaaaattatttctgagacagaggaatctttaaagaatcatttgaacggaaaaagacttgatgagatttttaatgcagaatcttttaatgatgtattagcacaaagtggaattgacttctataacactgttattggtggtatttctacagaaacagaaaaagttcaaggtttgaatgaaaaaataaatcttgcaagacaaaaacttcccgcagaagaaaaaaataaactacggggtaaaatggtagttttgtttaagcagattttaagtgatagaggaacatcatcttttattcctgttggttttaacaacaaggaagaagtctattcttctgtaaaatcattcaatgatgaatttgtaaatatttctgtttgtgaaacaaaagaattattcaaacaagttgcagagtttaatcttagtgaaatttatgttccagcaaaatctttaacaaacttttcgcaaaatatttttggttcttggtcaattctaacagaaggacttttcttattagaaaaagataaagtgaaaaaagcattatcagaaaataaagaagaaaaaatcaacaaagagattgcaaaaaaagattattctttggatgagttacaagttgcttatgaaagatattgtaatgaacataatttttcagtagagaaaaattgcaaagattattttgatgttgttgattatcgatcagaaaatgaaaaatctgataagaaaaaaatttctatactttcagctattacagaatcttattcaaaaatagattttgaaaatattcatgatttacaacaagaaaaagaagccgctacaccaattaaaacatatttggatgaagttcagaatttatatcatcatctaaaacttgttgattatcgtggggaagaacaaaaagattcaaacttttattcaaaattggatgaaatcattactcagctttcagaaattattcctttatacaataaagttagaaactttgttacaaagaaacctggtgaaatgaagaagataaaattgaattttgattgtcctactctagctaatggatgggatgaaaataaagaatcttcaaatgatgcaataattttaagaaaggatggtaaatattatttaggaatttttaatccaaataataaaccaaaattttctaaaatcgaaaacatttctgaatcatactacgaaaaaatggtgtataaacttttaccaggcccaaacaagatgttaccaaaagtctttttttcaacaaaaggacaagaaacatttttgccaccaaaagatttgctcttaggatatgatgcaggtaaacataaaaaaggtgatgcttttgataaagaatttatgtataaattaattgattggtttaaagatgcaattaatcgtcatgaagattggaaaaaatttaattttgtattctctcctacaaaatcttacgaagatatgagtggtttttatagggaagttgaattacaagggtataaagtttcttttcaaaaaatatctgacacagaaataaattcttttgtaagcaacggaaaacttttccttttccaaatatacaataaagactttgctttaaaagcttctggaaagaaaaatcttcatacactttattgggaaaatctttttagtgaagaaaacttaaaagatgtttgtctaaaattaaatggagaagcagaattattctggagaaaaccaagtttgaacaaagaaaaagttactgttcacgaaaaaggttcaattcttgtaaataggacaacaaatgacggaaagtcaattccagaagacatttatcaagaaatttatcaattcaaaaataaaatgaaagataaaatttctgacaatatttctatacagaatgatgatggtaaagtcattacgattacagtaactttggaaaataagcaaaaagaaaaattcacagaaaattataaagttgtatataaaactgcaactcactatattacaaaggataatcgttttacagaagacacttatcttttccattgtcctattacaatgaactttaaggcacctgataaatcaaataaagaatttaataatcatgttcttgaagtattgagtggtaatcctaatgtaaaaattattggattggatcgaggcgaaagacaccttatttatctttcattgataaatcaaaaaggtgaaattgaacttcaaaaaacattaaatcttgttgaacaagttagaaatgataaaactgtaaaagtaaattatcaagaaaaacttgtacacaaagaagatgatagagataaggctcgtaaaagctggcaaacaattggaaatatcaaagaattaaaagaaggctatctttcaaatgttgttcatgaaattgcaaaaatgatggttgaacataacgcaattgttgttatggaagatttgaattttggatttaagcgggggcgttttgctgtagaaagacagatttatcaaaaatttgaaaatatgttaattgaaaaactaaattatcttgttttcaaagataaaaaggtaacagagcctggtggtgttcttaatgcttatcaattaacaaataaatctgcaaatgtatctgatgtctacagacaatgtggatggcttttctatattcctgctgcttatacttcaaagattgatccaaaaactggttttgcaaatctttttattacaaaaggcttaacaaacgtagaaaagaaaaaagaattttttgataagttagattctattcgttatgactcaaaagaagattgttttgtttttggatttgattatggaaaaatctgtgataatgctgattttaagaaaaagtgggaagtttatacaaaaggggaacgacttgtttacaataaaactgaacgcaagaatattaacataaatccaacagaagaattgaagtcaatctttgatgactttggaataaattggaataatgaagaaaattttattgattctgtccatacaatccaagctgaaaaatcaaatgcaaaattctttgatacacttttaagaatgtttaatgcaactttgcaaatgagaaattctattccaaacacggaaattgactacttaatttctcctgtaaaatcagaagatggaactttctttgattctagagaagaattgaaaaaaggtgaaaacgcaaaattaccaattgatgcagatgcaaacggagcttatcacattgcattaaaaggtttgtatttgttggaaaatgactttaaccgtaatgataaaggtgtaattcaaaacatctccaacgccgattggtttaagtttgttcaggagaaagaatatagggattaa

SEQ ID NO: 367 - DNA, 3897 bp, synthetic construct
  source 1..3897: mol_type = other DNA
atgacaactattaacaaattttgcggacaggggaatgggtattctcgagcaattactttaagaaataagttgattcctattgaaaaaacagcggacaacttaaaacaatttttggaaaaggatcaagaaagagctgattcttatcctgaaattaaaaagttgattgatgaagtgcatcggggatttatcgaggatactcttacaaaattctcatttgtatgggaacctttatttgatgattttgaattatatcaaaatgaaaaggataaatctaaaaaagctgcgaagaaaaaagatttagagaaatttcaaagtggagcaagaaaaaaaattgttgaagcttttaagaagcatcctgattatgacaaacttttcaaagatggattgtttaaggaattattaccagctttgataaaaaattcttctgactctgaaatatcaaataaagaagaagcattaaaagtttttgatagatttagtacatattttgttgggtttcacgaaaatagaaaaaatatgtatagcgaagaagaaaaatttactgcaataagctatagaatagttaatgaaaactttccaaaattctatgccaatgtaaaattgtacaattatttaaaagaaaatttcccacaaattatttctgagacagaggaatctttaaagaatcatttgaatgaaaaaaaacttgatgagatttttaatgtagaatcttttaatgatgtattagcacaaagtggaattgacttctataacactgttattggtggaatttctacagaaacagaaaaagttcaaggtttgaatgaaaaaataaatcttgcaagacaaaaacttcccgcagaagaaaaaaataaactacgggggaaaatggtagttttgtttaagcagattttaagtgatagaggaacatcatcttttattcttgttgattttaacaacaaggaagaagtttattcttctgtaaaatcattcaatgatgaatttgtaaatctttctgtctgtgaaacaaaagaattattcaaacaagttgcagagtttaatcttagtgaaatttatgttccggcaaaatctttaacaaacttttcgcaaaacatttttggttcttggtcaattttaacagaaggacttttcttattagaaaaagataaaatgaaaaaagcattatcagaaaatcaagaagaaaaaataaataaagagattgcaaaaaaagattattctttggatgagttacaggttgcttatgaaagatattgtaatgaacataatttttcagtagagaaaaattgcaaagattattttgatgttgttgattatcgatcagaaaatgaaaaatctgataagaaaaaagtttctatactttcagctattacagaatcttattcaaaaatcgattttgaaaatattcacgatttacaacaagaaaaagaagccgctacaccaattaaaacatatttggatgaagttcagaatttatatcatcatctaaaacttgttgattatcgtggtgaagaacaaaaagattcaaacttctattcaaagttggatgaaatcattactcagctttcagagattattcctttatacaataaagttagaaactttgttacaaagaaacctggtgaaatgaagaagataaaaatgatgtttgattgtagttctttattaggaggatggggaactgattatggaacaaaagaagctcatatttttattgattctggaaaatattatttgggaattataaacgaaaaattatcaaaagatgatgtagagttattaaaaaaatcaagtgaaagaatggtaacaaaagttatttatgattttcagaaacctgataataaaaatacacctcggttatttattcgttcaaaaggaacaaattatgcccctgctgtttctcaatataatttgccaatagaatctattattgatatttatgatagaggattgtttaaaaccgaatatagaaaaatcaatccagaagtttacaaagaatcattaataaaaatgattgactatttcaagttaggatttgaaagacatgaatcatataagcattatccattctgttggaaggaatcttcaaaatataatgatattggagaattttataaggatgtaataaattcatgctatcaattacattttgaaaaagtgaattatgataatttattaaaattggttgaaaataataaaatatttcttttccaaatctataacaaagattttgcagaaaaaaaatctggaaagaaaaatcttcatacactttattgggaaaatctttttagtgaagaaaacttaaaagatgtttgtctaaaattaaatggagaagcagaactattctggcgaaaaccaagtttaaacaaagaaaaagttactgttcacaaaaaaggttcaatccttgtaaatagaacaacaaatgatggaaaatcaattccagaagatatttatcaagaaatttatcaattcaaaaataaaatgattgataatctttcagagaacgcaaaatcattgttagattctggagttgttgtttgtaaagaagcaactcataatattacaaaggataatcgctttacagaagatacttatcttttccattgtcctattacaatgaactttaaggctcctgataaatcaaataaagaatttaataatcaagttcttgaagtattgagtgataatcctgatgtaaaaattattggattagatcgtggagaacgacaccttatttatctttcattgataaatcaaaaaggtgaaattgaacttcaaaaaacattgaatcttgttgatcaagttagaaatgataaaactgtaaaagttaattatcaagaaaaacttgtacacaaagaaggtgacagagacaaggctcgtaaaaactggcaaacaattggaaatatcaaagaattaaaagaaggatatctttcaaatgttgttcatgaaattgcaaaaatgatggttgaacataacgcaattgttgttatggaagatttgaattttggatttaagcgggggcgttttgctgtagaaagacagatttatcaaaaatttgaaaatatgttaattgaaaaactaaattatcttgttttcaaagataaaaaggtaacagagcctggtggggttcttaatgcttatcaattaacaaataaatctgcaaatgtatctgatgtctacagacaatgtggatggcttttctatattcctgcagcttatacttcaaagattgacccaaaaactggttttgcaaatctttttattacaaaaggcttaacaaacgtagaaaagaaaaaagaattctttgacaagtttgattctattcgttatgactcaaaagaagattgtttcgtctttggatttgattatggaaaaatctgtgataatgctgattttaagaaaaagtgggaagtttatacaaaaggtgaacgacttgtttacaataaaacagaacgcaagaatattagcataaatccaacagaagaattgaagtcaatctttgatgactttggaataaattggaataatgaagataattttattgattctgtccatacaatccaagctgaaaaatcaaatgcaaaattttttgatacacttttaagaatgtttaatgcaactttacaaatgagaaattctattccaaacacagaaattgactacttaatttcaccagtaaaatcagaagacgggactttctttgattctagagaagaattgaaaaaaggtgaaaatgcaaaattgccaattgatgcagatgcaaacggagcttatcacattgcattaaaaggcttgtatttgttggaaaatgactttaaccgtaatgataaaggtgtaattcaaaacatttctaacgccgattggtttaagtttgttcaggggaaagaatatgaaaaatga

SEQ ID NO: 368 - protein, 1321 aa, synthetic construct
MKMSEQFCGQGNGYSISKTLRFELKPQGATLENIKKLKLIESDLQKSQDYKDVKIIIDNYHKYFIDEVLQNVNLDWTKLADALIEYSKTKEDDSNVIKEQDALRNEIVKLISKDERFKPLTAPTPKDLFNSLLPEWFEKNASSALNEKAVETFKKFCAYFKGFQENRKNMYKEEAIPTAVPYRIVHDNFPKFLQNVASFAEIQKKCPEIIEQTETELSAYLENEKLSDIFNVKNYNKYLCQTGAEKQRGIDFYNQVIGGIVQNENDKKLRGLNEFLNLYWQKHADFAKTNRKVKFIPLYKQILSDRTSLSFKIQTIGSDQELKEAILSFAEKMNSKNNDGKTVFDVATELCETITQFDLSQIYVNQKDINNVSRILTGDWAYLQKRMNIFAEETLNKKEQKRWKKELDDDTSKTKGIFSFEELNAVLEYSSENCSPTTIRMQDYFGTTSRWYFDKQTEIFTKSGEIIEPSIKDLCAEIENNFIAMDKIFETVPSEKTLREKPADVEKIKNYLDSVQNLLHRIKPLKVNGLGDANFYTAYDEVYXALGEVXSLYNKTRNYIAKKVGAPEKFKLNFDNPTLADGWDQNKESSNTSIILIKDDKYFLGIMNAHDKPQFQEKXESNGEKCYQKMIYKLLXGPXKMLPKVFXXKKGISNFNPPKNILAGYDEXKHIKGDKFDIXXCHQLIDWXKDAISRHDDWKKFGFSFXATDSYKDXSDFYREVSXQGYKINXVXIPESXIDEMVXXXKLYLFQIYNXDFAEGASGTLNMHTLYWKNLFSKENLQDTVLKLNXEXELXYREKGINDPIVHKKGSKLVNKVTQDXFSIXTEIYTEIYKFENGKQDKLSDEARKYFDEHKVIVKTAGXDITKDRRFTEPXFLFHVPITINFKAQGNTFAMNEXVRKFLKNNPDVNIIGLDRGERHLIYLSLVNQNGEILKQFXFXEVGRXKNGQLVKVNYHEKLDNREKERDAARKNWNXIGKIAELKEGYLSAVIHELAKLMIQYNAVIVMEDLNFGFKXGRFHVEKQVYQKFEHMLIDXLNYXXFXDKXFSEXGGVLNGYQLAGQFESXQKXGKQSXFLFXVXAAXTXKIDPKTGFADLLNLRDLXNVHKKRDFFSKFDXXXYXAETXSFAFXFDYKXFDGKGXSEMSATKWTVYSREKRIVYSPKSKSHSDVYPTXELKKIFXXXSIDFESGNNXIDSIMEXGAXLKQNEKPTXDVANFWDAMLRNFKLILQMRNXXXASGEDYXISPXKNXDGXFFDSRKEKXLGDKAKLXXDADANGAYHIALKGLLLLKRFXKTEESNXXKXXXXISXAXWFEFAQNRNN

SEQ ID NO: 369 - protein, 1287 aa, synthetic construct
LESDKKKSEDYKDAKKIIDNYHCYFIDDVLKTLSLNWENLAKEINEYRKSKSDDVNLLSAQQKQRDEILKVFNSDKRFKALIASTPKDLFNKLLPEWFKKDNSVELNKEATETFKRFYSYFKGFQENRENVYSSKEIPTAVPYRIVNDNFPKFLSNISVFETIQKKCPDVITDVENELKEYLGNEKLSDIFSIQSFNKYLCQSGAENQRGIDFYNQIIGGIVEKDKEQNLRGINQFLNLYWQQHPEFAKNNKRIKMVPLFKQILSDRTSLSFKIEAIDSDDELIQAIEDCANKLEEKSKDDGKSIFEKCCELFDSINEQDLNEIYINRKDINNFSRILTGDWAWLQARMNYYAEEKFTTKAEKSRWVKSLEDEGENKSKGFYTLAELNDVLKYSSDNIPETNIRIADYFGRRYRYFYEKETGNYIPSEELVALSIEEMCDDILVKRKNMDKAFETSEKEKLQEDSETVSKIKDYLDSLQELLHRVKPLKVNGVGESSFYANFDTVYNALKEVISVYNKTRNYLTKKVASPEKYKLNFDNPTLADGWDLNKEQANTSVLFRKNGMFYIGIMNPKDKPKFAEKYEVKDEDFYEKMVYKLLPGPNKMLPKVFFSTKGKETFNPPKEILNDYEKGKHKKGDSFDIDFCHKLIDWFKNAINQHEDWKKFDFKFSDTKNYKDISDFYREVTEQGYKLSFTNIPVSEIEKMVEDGKLYLFQIYNKDFSSESKGTPNMHTLYWKNLFSEENLKDVCLKLNGEAELFYRPVGIKNPIVHKKDSYLVNKLTKDGKSIPENIYEEIYKNANGKLDKLSKDAEEYKRTHDVVIKVAKHDIIKDKHYTVPKFLFHVPITINFKASGNSYSLNENVRKFLKNNPDVNIIGLDRGERHLIYLSLINQKGEILEQFSFNTVEQSRNDAEPRIIDYHEKLNQREKERDEARKSWQTIGKIAELKEGYLSAVIHKLAQLMIKHNAIVVMEDLNFGFKRGRFHVEKQVYQKFEHMLIDKLNYLVFKDKGLTEAGGVLNGYQLASQFESFQKLGKQSGMLFYVPAGYTSKIDPKTGFVNMFNFKDLTNVHKKRDFFSNFKSISFDNDTDSFVFTFDYKDFNGKAKEEMFISKWSVYSREKRIVYYSKTKSYEDVLITEKLKSAFQKVNIDYTNGNDLLDSIMGIGADLKNGEKPSKEVADFWDTLLYNFKLILQMRNSNARTEEDYIISPVKAPDGTFFDSREEGKKEHNATLPKDADANGAYHIALKGLSLLKRFDVADEKSLKKFDMKISNADWFKFVQEKEYKD

SEQ ID NO: 370 - protein, 1369 aa, synthetic construct
MEKTMDDFTNLYSLSKTLRFELKPIAETKENIEKGKFLESDKKKAADYKAVKKIIDNYHKYFIDDVLKNASFTWTKLEEAIKEYNKNRNDDSVVENEQKKLREEILKLFTSDKRYKALTAATPKDLFDTILPEWFGENSNPDLNKTALKTFQKFTSYFTGFQENRKNVYSAEPIPTAVPYRIVNDNFPKFLQNISIFKTIQEKCPQVIDDVEKELSSYLGKEKLADIFTLESFNKYLGQGGKENQRGIDFYNQIIGGIAEKEGEQNLRGINQFLNLYWQQNPEFAKENRRIKMVPLYKQILSDRSSLSFKIESIENDEELKIALLECADKLEGKNEEKKSVFEDTCDLFESLKNQNLQEIYINRKDIKTVSRILTGDWSWLQTRMNVYAEEKFTTKAEKARWQKSLDDEGENKSKGFYSLAELNKVLEYSSENVTETDIRITDYFEHRCRYYIEKESERFVQGSELIALSIKEMCDDIQTKRKGMDRVLENLSDEKLLKEKTEDIAVIKNYLVAVQNLLHRIKPLKVNGVGDSSFYAIYDSIYSALSEVISVYNKTRNYITKKAASPEKYKLNFDNPTLADGWDLNKEQANTSVLLRKDGMYYLGIMNPKNKPKFAEKYEVADGQSCYEKMIYKQFDATKQIPKCSTQKKEVQKYFLSGATEPYILNDKKSFKSELIITKDIWFMNNHVWNGEKFVPKRDNETRPKKFQIGYFKQTGDFDGYKNALSKWISFCKEFLQSYISSTVYDYNFKKSDEYEGLDDFYNYLNATCYKLTFINIPESEIEKMVSEGKLYLFQIYNKDFAPGANGRPNMHTLYWKNLFSDENLKNVCLKLNGEAELFYRPAGIKDPVVHKEGSYLVNRTTEDGESIPEKIYLEIYKNANGKLDSLSDEAKSYKENHKIVIKKASHEIIKDRHYTEAKFLFHVPITINFKASGNSFSINENVRRFLKNNPDVNIIGLDRGERHLIYLSLINQKGEILKQFTFNEVERDKNGQTVKVNYHEKLDQREKERDSARKSWQTVGKIAELKEGYLSAVIHQLTKLMVEYNAIVVMEDLNFGFKRGRFHVEKQVYQKFEHMLIDKLNYLVFKDRGLNEPSGVLNGYQLTGQFESFQKLGKQSGMLFYVPAGYTSKIDPKTGFVSMMNFKDLTNVHKKRNFFSNFNDIHFDDATGSFVFTFDYKNYDGKAKEEMKQTKWSVYSRDKRIVYFPKVKSYEDIQPTEKLKALFETAGIDYKSGNPILDSIMTIGADLKEGAKPSKEIAEFWDGLLYNFKLILQMRNSNARTGEDYIISPVMADTGTFFDSREELKKGEDAKLPLDADANGAYHIALKGLELINKINLTDENELKKMKISISNADWFQFAQEKNYAKG

SEQ ID NO: 371-372 - skipped (2 entries)

SEQ ID NO: 373 - DNA, 4110 bp, synthetic construct
  source 1..4110: mol_type = other DNA
atggagaagaccatggatgatttcactaacttatacagcctcagcaaaactctccgcttcgaattgaagcctattgctgaaaccaaggaaaatatcgagaaaggaaagtttctcgagtctgataaaaaaaaggccgccgactataaagccgtcaagaaaatcatagacaactaccataagtacttcattgatgatgttctcaagaatgcctcctttacttggaccaagctggaggaagctatcaaggagtacaacaaaaatcgcaacgacgactccgtggttgaaaatgagcagaaaaaactgagagaggagatacttaagctcttcacctccgacaagagatataaggcgttaacagctgcaactcccaaggatctgtttgacaccattttgccggaatggttcggcgagaactctaatcctgacctgaacaaaactgccctgaagacgttccaaaaattcacgagttattttacagggtttcaagaaaaccgcaaaaacgtgtatagcgcagagcccattccaactgcggtgccgtataggattgtgaacgacaattttcctaagttcctgcagaacatcagtatttttaaaaccatccaggagaaatgcccacaggtgatcgacgatgtagaaaaagagctctcaagctatctcggtaaagaaaagcttgccgatatcttcactctggaaagctttaataagtacctgggccagggcggaaaggagaaccagcgtgggatcgatttctacaatcagatcatcggtggaatcgcggagaaggaaggagaacaaaatcttcgcggcattaatcagttccttaatctgtattggcagcagaatcctgagttcgccaaagagaataggcgtattaaaatggtgcccctgtacaagcaaatattgtctgaccggtcaagcctctctttcaagatagagagcatagaaaacgatgaagagctgaagattgctctgctagagtgtgctgacaaactagaaggaaagaacgaggaaaagaagtcagtttttgaagacacctgcgacttattcgagagcctcaagaatcaaaatctacaggagatctacatcaatcggaaagatatcaaaaccgtcagtcgcattctgacaggggattggtcttggttgcagacccgaatgaacgtttacgcagaagagaagtttacaactaaagccgaaaaagcccgctggcagaaaagccttgatgacgaaggagagaataagtctaaaggattctactcactcgctgaattaaacaaggtcttggaatatagctcagaaaatgtgacggaaaccgatattcgcatcactgactacttcgagcataggtgtagatattacattgagaaagagtcagaacggttcgtccagggctcggaactgatcgctctgtccattaaggagatgtgtgatgatatccagacgaagagaaagggaatggatagagtgctggagaacctaagtgatgagaaactgttgaaagaaaagaccgaagacattgccgtcattaagaactatctggtagcagtgcaaaatctcctgcatcggatcaagccacttaaagtgaacggtgtcggagattcttccttctatgcaatatatgactcgatctattctgccctctcagaagtgatctctgtctacaataagacgaggaactacattaccaaaaaagccgcctcccctgagaagtacaagctaaattttgacaaccctacactcgctgatggatgggacctcaataaggaacaggcaaacacctccgtgttgctgcgcaaagacgggatgtattacctggggataatgaacccaaaaaacaagcctaagtttgcagagaagtatgaggtcgccgatgggcagtcctgttacgagaagatgatatataagcagtttgacgccacaaaacaaattcccaagtgcagcacccagaaaaaagaggtgcagaaatatttcctctctggcgcgaccgaaccatatattctgaacgacaagaaaagcttcaaaagcgagctaatcatcaccaaagatatctggttcatgaataaccatgtgtggaatggcgaaaaatttgttcctaagagggacaacgagactcggcccaagaagtttcagattggctatttcaagcagacaggcgattttgacggctacaaaaatgctctgtctaagtggattagcttttgcaaggagttcctacaatcctacatctctagtactgtgtacgactacaatttcaagaaaagcgacgagtacgaaggacttgacgacttttacaactaccttaatgctacgtgttataagctgacctttattaacattcccgagtccgagatcgagaaaatggtgtcagaggggaaattgtacttgttccagatctacaacaaggattttgcacctggagcaaacggtaggcctaatatgcacacactgtattggaaaaatctgttttcagacgagaatctgaagaatgtgtgcctcaagctgaatggagaagccgagttgttctatagacccgccggcatcaaggacccagtggtacataaagagggctcttatctggtcaaccgaactacagaggatggggagtcaatcccagaaaaaatctacctggagatatacaagaacgctaacggtaagctggacagtctcagtgatgaggccaagtcttacaaggagaaccataagatcgtgataaaaaaggcatcacacgagatcataaaggataggcactacactgaagcaaagtttctctttcacgttcctattaccattaacttcaaagcatcgggcaactccttctctataaacgagaatgttcgaaggttccttaaaaacaaccccgatgtgaatatcattgggctcgaccgtggcgaacggcatcttatatacctcagtctcattaaccagaagggggagatcctgaaacaatttacgtttaatgaggtagagagagataagaatggtcagacagtgaaggtgaattaccacgagaagctggatcagagagagaaagaacgtgactctgcccgcaaatcatggcaaacagtagggaagattgctgagcttaaggaggggtacctgtccgccgttatccaccagctgaccaagttaatggttgagtataatgccatcgttgtgatggaggatctgaacttcggatttaagaggggcagatttcatgtcgaaaagcaagtgtatcagaaattcgaacacatgctgatcgataagctgaactatctggtctttaaagatcggggccttaatgaaccaagtggggtgctaaacgggtaccaactgaccggtcaattcgaaagtttccagaaactgggcaaacagtcgggtatgttattctatgtccccgccggctatacaagcaaaattgacccaaaaaccgggttcgtatccatgatgaattttaaagacctgacaaatgtgcacaagaagcggaatttcttcagtaacttcaatgacattcactttgatgatgctacaggatcctttgtgttcacattcgactacaagaactacgacgggaaagccaaggaggagatgaagcagaccaagtggagcgtatattccagggataaacgaatcgtctacttccccaaagtcaagtcctatgaggatattcagccgaccgagaagttgaaagcgctttttgaaactgctggcatagactacaaatcaggaaaccccatattggatagcattatgactatcggcgccgacctcaaagaaggcgctaagccgtccaaggaaatcgctgaattctgggacggtcttttatataactttaagctgatcctgcagatgcggaatagtaacgctagaacaggtgaggactacatcataagtccagttatggctgacaccggtacattttttgatagccgagaggaattaaagaaaggcgaagacgccaaattgcccctggatgcagacgcgaacggagcataccacattgcgctgaaaggcttagaactcatcaacaagatcaacttgactgacgagaatgagcttaagaagatgaagatctccattagcaacgccgactggttccagtttgcccaggaaaagaattatgcaaaagggtga

SEQ ID NO: 374 - DNA, 36 bp, synthetic construct
  source 1..36: mol_type = other DNA
atctacaacagtagaaattttgtattggtttcaaac

SEQ ID NO: 375 - DNA, 35 bp, synthetic construct
  source 1..35: mol_type = other DNA
tctacaacagtagaaattttgtattggtttcaaac

SEQ ID NO: 376 - DNA, 36 bp, synthetic construct; identical to SEQ ID NO: 353
  source 1..36: mol_type = other DNA

SEQ ID NO: 377 - DNA, 35 bp, synthetic construct; identical to SEQ ID NO: 354
  source 1..35: mol_type = other DNA

SEQ ID NO: 378 - DNA, 36 bp, synthetic construct
  source 1..36: mol_type = other DNA
atctacaacagtagaaatttaatatgaagttcaaac

SEQ ID NO: 379 - DNA, 35 bp, synthetic construct
  source 1..35: mol_type = other DNA
tctacaacagtagaaatttaatatgaagttcaaac

SEQ ID NO: 380 - RNA, 36 nt, synthetic construct
  source 1..36: mol_type = other RNA
gtttgaaaccaatacaaaatttctactgttgtagat

SEQ ID NO: 381 - RNA, 36 nt, synthetic construct; identical to SEQ ID NO: 360
  source 1..36: mol_type = other RNA

SEQ ID NO: 382 - RNA, 36 nt, synthetic construct
  source 1..36: mol_type = other RNA
gtttgaacttcatattaaatttctactgttgtagat

SEQ ID NO: 383-385 - skipped (3 entries)

SEQ ID NO: 386 - protein, 1257 aa, synthetic construct
LRSKMAKNTIFSKFTELYPVSKTLRFELKPIGKTLEKIKENGIIDHDKNKADNYVDAKKIIDEYHKYFISEALKGINLDWSPLRDAFIDSLTNRTQDSKKKLEDLQKTFRKKIAEKLAAHPHFKELTATTPKDLFKNILPDHFGNDESIESFKGFSTYFKGFQENRQNIYSAEAISTGVPYRIVHDNFPKFLSNIETFQNIQKHCLSVLTDAETELKKLLNGQKLVEIFNIDFFNNVVTQEGIDFFNQIIGGYTIENNTKIRGINEFANLYRQQNPEFAKLRIATRMIPLYKQILSDRDSMSFILEPFKDASQVQSAVKDFFEDHILHYTTDGSQINVLDKIANLVASLNNFDSEKIFIARESLSQISQKIFGNWNSINDAFFEYCEKQFGSAQKTANKKKIDAKLKEDCYSIKEINCVIKKIDSSKQILDYWKEFDSLKNNIESGDIYKKYVDFISLKFEPDEKLEKDDNIQGLKAFLDAINEFLHYVKPLIVNHENGDTAFYNELMPLYDQLSNIIPLYNKTRDFATQKPSDSAKFKLNFENPTLADGWDQNNEAKNTSIILKKEGNYYLGIMNAKDKPKIDTYKVNSNEPHYDKMVYKLIPSPHMSLPKAFFSKKGLALYKPSMQILDGYNANKHKKGSSFDKKYCHQLIDFFKEAISAHPDWKNFKFNFSETASYDDTSAFYNEISNQGYMLSFTSIPDSQIDTWIDEGKLFLFQIYNKDFAPGAKGKPNLHTLYWKATFSPENLKDVVFKLNGEAELFYRPCSIKKPYSHKIGEKMVNRITKDGRPIPDAIFGELFHYFNNSTKPSLSDDAKKYLDFVIVKDVKHEITKDKRYTEDKFEFHVPLTMNFKSSDGSRYINDRVKDFLKNNPDVNIIGIDRGERNLIYMTLINQKGEILIQKSFNLVGNTNYHEKLSIREQERDAARRSWRSIGKIKELKEGYLSLVIHEIAKTMIENNAIIVLEDLNFGFKRGRFCVEKQVYQKFEKMLIDKLNYLVFKDCSDSEYGGILKGYQLTQKFTSFKDIRKQNGFLFYIPAAYTSKIDPTTGFVNLFNFTDLTNAEKKKDFLTNFDDITFDSKTNSFAFTFDYSKFKVFQTDFQKTWTVFTNGKRIVYDRESKKYNTIEPTTIIQEALEKQGVQCVDQLNVLAEIEKIETKNASFFNSICYAFEKSLQMRNSNSETDDDYILSPVKNKNGVFFNSNEADDKLPKDADANGAFHIALKGLYLLQHISETDEKLKIPHEKWFEFVQSRNK

SEQ ID NO: 387 - protein, 1275 aa, synthetic construct
LSLFVAKKGYIKKNTILRSKMAKNTIFSKFTGLYPVSKTLRFELKPIGQTLEKIKENGIIDHDKNKADNYVNAKKIIDEYHKYFISEALKGVKLDWSPLRDAFIDSLTNRTQDSKKKLEDLQKTFRKKIAEKLAAHPHFKELTASTPKELFEKILPNHFGKEESVEAFKRFSTYFKGFQENRKNIYSADAISTGVPYRIVHDNFPKFLSNIETFQNIQKHCPSVLTNAETELKELLNGQKLAEIFNIVFFNSIITQEGIDFFNQIIGGYTIENNKKIRGINEFTNLYRQQNPEFAKQRIATRMIPLYKQILSDRESMSFILEPFKDASQVQSAVKDFFEDHILHYSTDGSQINVLDKISNLITSLNNFEPDKIFIARESLSQISQKFFGSWNSINDAFFEYCEKQFGSAQKAANKKKIDAKLKEDCYSINEINHVIKQIDPSKQISDYWKELESFKNNIESGDLYKKYEDFISLKFEPDAKLEKDDNIQGLKDFLDAINEFLHYVKPLTANHENGDTAFYNELMPLFDQLSNVIPLYNKTRDFATQKPSDSAKFKLNFENPTLADGWDQNKEDANTSIILKKGENYYLGIMNAKDKPKIDTYKVTPDEPHYDKMVYKLLPGPNKMLPKVFFSAKGKEIYNPSKEIQDGYAAEKHKKGPSFDKRFCHQLIDFFKEGISNHPDWKNFNFNFSETSSYEDISAFYNEVSDQGYKLSFTPIPDSQIDTWIDEGKLFLFQIYNKDFAPGAKGKPNLHTLYWKATFSPDNLQDIVFKLNGEAELFYRPCSIKKPYSHKIGEKMVNRITKDGRPIPDAIFGEIFHYFNNSTKPSLSDDAKKYLDFVIVKDVKHEIIKDKRYTEDKFEFHVPLTINFKADDGSKRLNDQIKDFLKNNPDVNIIGIDRGERNLIYMTLINQKGEILIQKSFNLVGNTNYHEKLSIREQERDAARKSWRSIGKIKELKEGYLSLVIHEIAKTMIENNAIIVLEDLNFGFKRGRFCVEKQVYQKFEKMLIDKLNYLVFKDCSDSECGGILKGFQLTQKFESFQKMGKQNGFLFYVPAAYTSKIDPTTGFVNLFNFTDLTNAEKKKAFLTNFDDITYDSKTSTFALTFDYSKFKVFQTDYQKTWTIFTNGKRIVYDRESKTHNTIEPTTIIQEALEKQGIQCVDQLNVLTEIEKIEPTRENARFFDSICYAFEKTLQLRNSNSETGDDYILSPVKNKNGIFFNSNEADDKLPKDADANGAFHIALKGLYLLQHISETDEKLKIPHEKWFEFVQSRNK

SEQ ID NO: 388 - DNA, 3774 bp, synthetic construct
  source 1..3774: mol_type = other DNA
cttcgttcaaaaatggccaagaataccatcttcagtaagtttactgagttgtatcctgtgtcaaaaaccttgcgattcgaattaaaaccaatagggaagacactggaaaaaatcaaggagaacggaattatcgatcacgacaagaataaagcagacaattacgtggatgctaagaagatcatcgacgagtaccacaaatactttataagcgaggcccttaaagggatcaatctggattggtcgccattgcgggatgcctttattgattccctgactaacagaactcaagattcgaagaaaaagttagaggatctacaaaagacctttcgcaaaaagatcgctgaaaagttggcagcacacccacatttcaaggaactgactgccacaacacccaaggacctgtttaagaacattctgcctgaccatttcggcaacgacgaatcaatcgaaagctttaaaggcttttccacgtattttaagggtttccaagagaataggcagaatatatacagcgctgaggcaatatccaccggtgtgccttacagaatcgtgcatgacaacttcccaaaatttctcagcaatattgagacattccagaacatccaaaagcattgtctgtccgtgctgactgacgccgagactgagttgaagaagctgttaaatggccaaaagctggtggagatattcaacatcgatttcttcaacaatgtcgtcacgcaggaaggtattgatttcttcaatcaaatcatcgggggttacacgattgaaaacaacaccaaaattaggggaatcaacgagttcgccaatctgtaccggcagcaaaacccagagtttgccaagttgcgcattgccaccagaatgatccccctgtataagcaaattctttcggatcgcgattctatgagttttatactcgagcctttcaaagacgcaagccaggtgcagtctgccgtcaaagactttttcgaagatcatatccttcactatacaacagatggctctcagatcaatgtgctagacaagattgctaacctcgtggctagtttgaacaatttcgactcagaaaagatcttcatagctagggagtcactgagccagatctctcagaagatctttggcaattggaattcaattaacgatgcgtttttcgagtattgcgaaaagcagtttggatctgcccaaaaaactgcaaacaagaaaaagatcgacgccaagctcaaggaggattgctacagtatcaaggagatcaattgcgtgattaagaagatcgacagctcaaaacagattttagactactggaaagagtttgactctttaaagaacaacatcgagtccggggacatttacaagaagtatgtcgacttcatttcactgaagtttgagcccgatgagaaattggagaaagacgacaatattcaggggctcaaggctttcctggatgccattaatgagtttcttcactatgtgaaaccgctcattgtcaaccatgaaaatggcgatactgcattctataacgagctaatgcctctgtacgaccagctgtctaatatcattccgttgtacaacaaaacacgcgatttcgcgacccagaagccttctgattccgcgaagttcaaactgaatttcgaaaatccaaccctagccgacggctgggatcagaacaatgaagcgaagaacactagcatcattttgaagaaggagggcaactattatctcggcatcatgaacgctaaagacaaacccaagattgacacatataaagtaaacagcaacgaaccacactatgacaagatggtatacaaactgattcccagcccccacatgtccttgcccaaggccttctttagtaagaaaggacttgccctctataaacctagtatgcagatcttagacggttataatgccaataaacataagaagggatctagcttcgacaaaaaatactgccaccagctcatcgatttctttaaagaggccatctccgctcaccccgactggaagaactttaaatttaacttcagcgagactgcatcgtacgatgatacctctgcattttacaacgagattagcaatcaggggtacatgctgagtttcacatctattcctgactcccagatagatacctggatcgacgaagggaagttattcctgtttcagatctacaacaaagattttgcaccaggcgctaaagggaaaccgaatctgcacaccctgtattggaaggcgacgtttagtcctgagaacctgaaagacgtcgtttttaaactgaacggcgaagctgagctcttctatcggccctgcagtataaaaaagccgtactcccacaaaatcggtgaaaagatggtcaataggataacaaaggatggacggccaattccggacgcgatctttggggaactgtttcattacttcaacaattcaacgaagccctctctgagcgacgatgccaagaaataccttgacttcgtaattgttaaggatgtgaagcatgagattacgaaagacaagcgctataccgaagataagtttgagtttcacgtccctctaacaatgaattttaaaagcagcgatgggtcaagatacatcaatgaccgtgtgaaagactttcttaagaataaccctgacgtgaatatcattggcatcgatcgaggcgagcgcaatcttatctatatgaccctcatcaatcagaaaggggagattcttatccagaagtccttcaacctcgttggcaacactaattaccacgaaaaattaagcatcagggagcaggaaagggatgctgcccgacggagctggcgaagtatcggcaaaattaaagaattgaaggaagggtatctgtcactcgtcatccacgaaatagctaaaacaatgatagagaacaacgccataattgttctcgaggatctgaatttcggatttaaacggggaaggttttgtgttgaaaaacaggtgtatcagaagttcgaaaaaatgctcatcgacaagctgaattacctagtgttcaaagactgttcagactctgaatatggtggtattctgaaaggctatcagctgacccagaagtttacctcctttaaggacattagaaagcaaaatggattcctcttctacatcccagctgcctatacgtccaaaattgatcccaccactggatttgtcaacctcttcaatttcaccgatctgactaatgcagagaagaagaaggattttctgaccaattttgacgatatcacctttgactctaagacaaattcttttgctttcactttcgattactccaagttcaaggtgttccaaaccgacttccagaagacatggacagttttcaccaatggaaagagaatagtgtatgaccgtgagtctaaaaagtacaacactatagaacccaccacaatcatacaggaagcgctcgagaagcagggggtgcaatgtgtagaccagctcaatgttcttgccgagattgagaaaatcgagacaaaaaacgcaagtttctttaactccatttgttacgcattcgaaaagtcccttcagatgagaaactccaacagcgaaaccgacgacgattacatattgagtcccgttaaaaacaagaacggcgtattctttaactccaacgaggccgatgataaactgccaaaagatgccgacgctaacggcgcctttcacattgcactaaaaggactgtacctgctgcagcatatatcagaaactgacgaaaaactgaagattcctcatgagaagtggttcgagttcgtgcagagccggaacaagtga

SEQ ID NO: 389 - skipped

SEQ ID NO: 390 - DNA, 36 bp, synthetic construct
  source 1..36: mol_type = other DNA
gcctagaaacttcaaaaaatttctactcttgtagat

SEQ ID NO: 391 - DNA, 35 bp, synthetic construct
  source 1..35: mol_type = other DNA
cctagaaacttcaaaaaatttctactcttgtagat

SEQ ID NO: 392 - DNA, 36 bp, synthetic construct
  source 1..36: mol_type = other DNA
gcctagaagcttcaaaaaatttctactcttgtagat

SEQ ID NO: 393 - DNA, 36 bp, synthetic construct; identical to SEQ ID NO: 392
  source 1..36: mol_type = other DNA

SEQ ID NO: 394 - RNA, 36 nt, synthetic construct
  source 1..36: mol_type = other RNA
gcctagaaacttcaaaaaatttctactcttgtagat

SEQ ID NO: 395 - RNA, 36 nt, synthetic construct
  source 1..36: mol_type = other RNA
gcctagaagcttcaaaaaatttctactcttgtagat

SEQ ID NO: 396 - protein, 1275 aa, synthetic construct
LSLFVAKKGYIKKNTILRSKMAKNTIFSKFTXLYPVSKTLRFELKPIGXTLEKIKENGIIDHDKNKADNYVBAKKIIDEYHKYFISEALKGXXLDWSPLRDAFIDSLTNRTQDSKKKLEDLQKTFRKKIAEKLAAHPHFKELTAXTPKXLFXXILPBHFGXXESXEXFKXFSTYFKGFQENRXNIYSAXAISTGVPYRIVHDNFPKFLSNIETFQNIQKHCXSVLTBAETELKXLLNGQKLXEIFNIXFFNXXXTQEGIDFFNQIIGGYTIENNXKIRGINEFXNLYRQQNPEFAKXRIATRMIPLYKQILSDRXSMSFILEPFKDASQVQSAVKDFFEDHILHYXTDGSQINVLDKIXNLXXSLNNFXXXKIFIARESLSQISQKXFGXWNSINDAFFEYCEKQFGSAQKXANKKKIDAKLKEDCYSIXEINXVIKXIDXSKQIXDYWKEXXSXKNNIESGDJYKKYXDFISLKFEPDXKLEKDDNIQGLKXFLDAINEFLHYVKPLXXNHENGDTAFYNELMPLXDQLSNXIPLYNKTRDFATQKPSDSAKFKLNFENPTLADGWDQNXEXXNTSIILKKXXNYYLGIMNAKDKPKIDTYKVXXBEPHYDKMVYKLJPXPXXXLPKXFFSXKGXXJYXPSXZIXDGYXAXKHKKGXSFDKXXCHQLIDFFKEXISXHPDWKNFXFNFSETXSYXDXSAFYNEXSBQGYXLSFTXIPDSQIDTWIDEGKLFLFQIYNKDFAPGAKGKPNLHTLYWKATFSPXNLXDXVFKLNGEAELFYRPCSIKKPYSHKIGEKMVNRITKDGRPIPDAIFGEJFHYFNNSTKPSLSDDAKKYLDFVIVKDVKHEIXKDKRYTEDKFEFHVPLTXNFKXXDGSXXJNDXXKDFLKNNPDVNIIGIDRGERNLIYMTLINQKGEILIQKSFNLVGNTNYHEKLSIREQERDAARXSWRSIGKIKELKEGYLSLVIHEIAKTMIENNAIIVLEDLNFGFKRGRFCVEKQVYQKFEKMLIDKLNYLVFKDCSDSEXGGILKGXQLTQKFXSFXXXXKQNGFLFYXPAAYTSKIDPTTGFVNLFNFTDLTNAEKKKXFLTNFDDITXDSKTXXFAXTFDYSKFKVFQTDXQKTWTXFTNGKRIVYDRESKXXNTIEPTTIIQEALEKQGXQCVDQLNVLXEIEKIEXXXXNAXFFBSICYAFEKXLQXRNSNSETXDDYILSPVKNKNGXFFNSNEADDKLPKDADANGAFHIALKGLYLLQHISETDEKLKIPHEKWFEFVQSRNK

SEQ ID NO: 397 - DNA, 3774 bp, synthetic construct
  source 1..3774: mol_type = other DNA
ttgaggtcaaaaatggctaaaaataccatattctccaagttcaccgaactttacccggtttctaaaaccctgcgctttgaattgaagcccattggcaaaacccttgaaaaaatcaaggaaaatggaattatcgaccatgataaaaacaaagccgataattatgttgatgcgaagaaaattatagatgagtaccataaatatttcatcagcgaagcattaaaaggaatcaacttagactggtcaccactccgtgacgcatttatagattcattgaccaacagaactcaagatagcaagaaaaaactcgaggatttgcagaagactttcagaaaaaaaattgccgaaaaacttgctgcacatccacactttaaggaactaacagccacaacgcctaaagatttgtttaaaaatattcttccggatcattttgggaacgacgaatctattgaatcttttaaaggattttctacttactttaagggtttccaagaaaacaggcagaacatctattctgcagaagcaataagcactggagtgccataccgaattgttcatgacaattttcctaaatttttatccaacattgaaactttccagaacattcaaaagcattgtctttctgttcttaccgacgccgaaacagaattaaaaaaactactaaacggccaaaaacttgttgaaatattcaatattgattttttcaacaatgttgtcacacaagaaggtatcgatttcttcaatcagataatcggcggctacacaattgaaaacaatactaaaattcgcggaatcaacgaatttgcaaatctctaccgtcaacaaaatcctgagttcgcaaaactgcgcatcgcaactagaatgattcccttgtacaagcaaatcttaagcgatcgggattcaatgtcgttcattctagaacctttcaaagacgcttctcaagtgcaatcggctgtaaaggacttttttgaggaccacattttgcattatactaccgatggctctcaaattaacgttctggacaaaattgccaatttggtcgccagtttaaacaattttgattcagaaaaaattttcattgctagagaatctctttcacaaatatctcaaaaaatctttggaaattggaattcgataaatgacgccttctttgaatattgcgagaaacaatttggctcagcacaaaaaactgctaataagaaaaaaattgatgcaaaattaaaggaagattgctattcaatcaaagaaataaactgtgtcatcaaaaaaatagactcttccaaacaaatattggactattggaaagagtttgatagtttgaaaaataatattgaatcgggtgacatttataagaaatacgtggattttatatctctcaaatttgaaccggatgagaaactggaaaaagatgacaatatacagggcttgaaggcatttctcgatgccattaacgaattccttcattatgtcaaacctttgattgttaatcacgaaaacggagatacggctttttacaacgaactaatgccgttatatgatcagttatctaatattattcctctatataacaaaacccgtgatttcgcaacgcagaagccatcagattcggcaaaatttaaactcaattttgaaaaccccactcttgcagatggctgggatcaaaacaacgaagccaaaaatacgtccataattcttaagaaagagggcaattattatttgggaataatgaatgccaaggacaaacctaaaattgacacatataaggttaactctaatgagcctcattatgacaaaatggtttacaaactcattccctctccacacatgtctcttcccaaggcatttttctcaaaaaaggggctggcgttatacaaaccctctatgcaaatattagatggttataacgcaaataagcataaaaaagggtcgtcttttgataagaaatattgccatcaattaattgatttcttcaaggaagctatttctgcacatcccgattggaaaaatttcaaattcaacttctcagaaacagcttcttatgatgacactagtgctttttataacgaaatttctaatcaaggatacatgctttcatttacttctattcccgattcacaaatcgatacatggattgatgaaggaaagttattcctgttccagatttacaataaggattttgctccaggagcaaaaggcaagcccaatttgcatacattatattggaaagcaacattctctcccgagaatttgaaagatgttgtatttaaattgaatggagaagcagaacttttctatcgtccttgcagcatcaagaaaccatactctcacaaaatcggtgaaaaaatggtgaaccgaataacaaaggacggcaggccaattcctgacgcgatatttggagaacttttccattatttcaacaattcgacaaagccttctttgagtgacgatgctaaaaaataccttgattttgtaatcgtcaaagatgtaaagcacgaaatcactaaagacaaacgatacaccgaagataaatttgaattccatgtgccattaaccatgaattttaaatcaagtgatggcagtagatacataaatgatcgcgtaaaggatttcctaaagaataatcctgacgtcaatatcattggaattgaccgtggtgaacgcaacctaatttatatgactcttatcaaccagaaaggtgaaattctgatacaaaagagttttaatctagtcggcaatacaaattatcatgaaaagctgtccattcgcgaacaggaacgtgatgccgcaaggaggagctggcgaagcatcgggaaaattaaggaactcaaagagggctacctcagccttgtcatccatgaaattgccaaaacaatgattgaaaacaacgcaattattgttcttgaagatttaaattttggatttaagcgtggacgattctgcgtcgaaaagcaagtatatcaaaagtttgagaaaatgctaattgacaagctcaattatcttgttttcaaagattgctcggattctgaatatggtggaattcttaaaggatatcagcttactcaaaaatttacgagtttcaaagacattagaaagcagaatggattccttttctatattcccgctgcttacacttctaaaatagatccaacaaccggtttcgtgaatcttttcaattttacagatttaacgaatgcggaaaagaaaaaggattttttgacaaattttgatgacattacttttgattctaaaacaaattcttttgcttttacttttgattacagcaaattcaaagtatttcaaactgatttccaaaagacatggacagtcttcaccaatgggaagagaatcgtctatgatcgagaatcaaagaaatataacacaattgagccgacaacgataatacaggaggctttggaaaagcaaggcgttcaatgtgttgatcaattaaatgtattggctgaaattgaaaaaatcgaaacaaaaaacgctagtttcttcaattctatatgttatgcttttgaaaaatcattgcaaatgagaaatagtaattctgaaactgatgacgactatatactttctccagtaaaaaacaagaatggagtattcttcaatagcaatgaagcagatgataaacttcctaaagatgcagatgcaaatggagctttccacatagctttgaaaggattgtatctgttgcagcatatatcagaaacagatgaaaaattaaagatacctcatgaaaagtggtttgaattcgtacagtctcggaataaataa

SEQ ID NO: 398 - DNA, 3828 bp, synthetic construct
  source 1..3828: mol_type = other DNA
ctgtcattatttgtcgcaaagaaaggttatattaaaaaaaacactattttgaggtcaaaaatggctaaaaataccatattctctaagttcaccggactttacccggtttctaaaaccctgcgctttgaattgaaacccataggccaaacccttgaaaaaatcaaggaaaatgggattattgaccatgataaaaacaaagccgataattatgtcaatgcgaagaaaattatagatgagtaccataaatattttatcagcgaagcgttaaaaggagtcaaattagactggtcaccactccgtgacgcatttatagattcattgaccaacagaactcaagatagcaagaaaaaactcgaggatttgcagaagacattcagaaaaaaaattgctgaaaagcttgctgcgcacccacactttaaggagctaacagcctcaacacccaaggaactatttgaaaagattcttccaaatcattttggaaaagaagaatctgttgaagcctttaaaagattctctacctattttaaaggattccaagaaaacaggaaaaacatctattctgccgatgcaataagtacaggagttccataccgaattgttcatgacaattttcccaagtttttatccaacattgaaactttccagaacattcagaaacattgtccttccgttcttaccaatgccgaaacagaattaaaagaactactaaacggacaaaaacttgcagaaatattcaatattgtttttttcaacagcattatcacgcaggaaggcatcgatttcttcaaccagataatcggtggatacacaatagaaaacaacaaaaaaattcgcggaatcaacgaatttacaaatctttatcgtcaacaaaatcctgaatttgcaaagcaacgaatcgcaacaagaatgattcccttatacaagcagattttaagcgatcgggaatcaatgtctttcattctagaaccctttaaagacgcatctcaagtacaatcggctgtaaaggacttttttgaggaccacattttgcattatagtaccgatggttcccaaattaacgttcttgacaaaatttccaatttgatcaccagtttaaataattttgaaccagataaaattttcattgctagagaatctctttcacaaatctctcaaaaatttttcggaagttggaattcgataaatgatgcattctttgaatattgcgagaaacaatttggctcagcacaaaaagcagccaataagaaaaaaattgatgcgaaattaaaggaagattgttattcgattaatgaaataaaccatgtcatcaagcaaatagacccatccaaacaaatatcggactattggaaagaattagaaagctttaaaaacaatattgaatcaggggacctttataagaaatatgaggattttatatctctcaaatttgaaccagatgcgaaactggaaaaagatgacaatatacaaggattgaaggatttcctcgatgccattaatgagttccttcattatgtcaagcctttaacagcaaatcacgaaaacggagacacggctttttacaacgaactaatgccattatttgatcagttatctaatgttattcctctatataacaaaactcgtgatttcgcaacgcagaagccatcagattcggcgaaatttaaactcaattttgaaaatccaactcttgcagatggctgggatcaaaacaaagaagacgcaaacacctcaataattctaaaaaaaggtgagaattattatttgggaataatgaacgccaaggataagcctaaaattgacacctataaggtcaccccggatgagcctcactatgacaaaatggtttataagcttcttcctggcccaaacaaaatgcttcctaaagttttcttctccgctaaaggaaaggaaatttacaatccatctaaagaaattcaagatggatatgccgcagaaaagcacaaaaaaggtccctcttttgacaaacggttctgtcatcagttgatagatttcttcaaggaaggcatttctaatcatccagactggaaaaatttcaactttaacttctcagaaacaagttcctatgaagacattagtgccttttataacgaagtttctgaccaaggttacaagctttcgttcactcctattcccgattcacaaatcgatacatggattgacgaaggaaaactgttcctgttccagatttataataaggatttcgcaccaggagcgaaaggcaagcccaatttacatacattatattggaaggcgacgttctctcctgataatttgcaagacattgtatttaaattaaatggtgaagcagaacttttctatcgtccatgcagcatcaagaaaccatactctcacaaaatcggtgaaaaaatggtgaaccgaataacaaaagacggcaggccaattcctgacgcgatatttggagagatcttccattatttcaacaattcgacaaagccttctttgagtgacgatgctaaaaaataccttgattttgtaatcgtcaaagatgtaaagcacgaaatcattaaagacaaacgttacaccgaagataaatttgaattccatgtaccattaactattaatttcaaggctgatgacggcagcaaacgcctgaacgaccagattaaggattttctaaagaataatcctgatgtcaatatcattggaattgaccgtggtgaacgcaacttgatttatatgactcttatcaaccagaaaggtgaaattctgatacaaaagagttttaatcttgtcggtaatacaaattaccatgaaaaattgtccattcgcgaacaggaacgtgatgccgcaagaaagagctggcgaagcatcggaaaaatcaaggaactcaaggagggttacctcagccttgtcatccatgaaatagcgaaaacaatgattgaaaataacgctatcattgttcttgaagacttgaattttggatttaaacgtgggcgattctgcgtcgaaaagcaagtgtatcaaaaatttgagaaaatgctaatcgacaaactcaattatcttgtttttaaagattgctcagattctgaatgtgggggaattcttaaaggattccaactcacgcagaaatttgaaagtttccaaaaaatgggcaaacaaaatggattccttttctatgttcccgcagcttacacttctaaaatagacccgacaaccggtttcgtaaatcttttcaattttacagatttgacaaatgcggaaaagaagaaagcgttcctaacgaattttgatgacattacttacgattctaaaacgagtacctttgctcttacttttgattacagcaagttcaaagtgtttcaaaccgattatcaaaagacatggaccattttcaccaacgggaagagaattgtctatgatcgagaatctaagactcataacacaattgaaccgacaacgataatacaggaggccttggaaaagcaaggtattcaatgcgttgatcaattaaatgtattgaccgaaattgaaaaaattgagcccactcgtgaaaatgctcgttttttcgattctatctgttacgcttttgaaaaaacactgcaattgagaaacagtaattctgaaactggtgatgactatatactttctccagtaaaaaacaagaatggaatattctttaatagcaatgaagcagatgataaactccctaaagatgcagacgcaaatggagcattccacatagctttgaaaggattgtatctgctgcaacatatatcagaaaccgacgaaaaattaaaaatacctcatgaaaagtggttcgaattcgtacagtctcggaacaaataa

SEQ ID NO: 399 - protein, 1245 aa, synthetic construct
MKDLKQFIGLYPVSKTLRFELRPVGRTQEWMEKNHVLEHDGKRAEDYPRVKELIDAYHKICISNSLKVSDINWTPLRDAIEKNRQEKSDESKKALEEEQTKMRLEICKKLAKFEHYQELVKADTPSKLINGILPHDKALDTFNKFAVYFEGFQENRRNIYSSEAISTGVAYRLVHDNFPKFLANIEVFENIKEICPEVIQQVATEMAPFLEGVMIEDVFTVSYYNAVLTQNGIDYYNQILGGVAKDDQKYRGINEFINLYRQAHPELATKKKSLTMVPLFKQILSDRETLSDIVRPVESEKQLIEVINNFYQRITNFDINGKNVNVVKELTDLVLSIDTYNPEGIFISAKSITDVSHSLYDHWNRINEKLYDKAVEAIGGVQTVKNKKKVEAYLKKDAYTLSELSFGDDVSISQYFSALTNSTDSINSLWLQFQSWCKSAEKPQFVHNEVGTEYVKMLLDAIMLVLHKCGALLVSLENELDSDFYNKFLPLYAELENVILVYTRVRNFLTKKLSDTGKIKLKFDTPSLGAGWGINKEKTNKAVLLFKDGLSYLGIMNVKGTLDFNCKIEADEPTFKKMVCRNYSKPYMDLPNSFFSQNGISKFHPSERIQKIYFAFKENSKNVDIKKVHELIDYYKDAISRHEDWGSFGFKYSPTESYETINDFYTEVAAQSYKLRFIEVPQKQVDEWVEEGKLYLFQLYNKDYAEGAHGRKNLHTMYWECLFSEENLSNLFIKLGGQAELFYRPQSIKKPVSHKVGTKMLNRRAKDGKPIPDAIYRSLYQYFNGKKAEAELTTEEKAYISQVIVKDVHHEIIKDRRYTKQFFYQFHVPIVFNANAPQRPKINERVLEYIKENPDVNIIGIDRGERHLVYLTLINQRGEILKQKTFNVVGDYNYQEKLKQRENERDQARKSWQSVGKIKDLKEGFLSAVVHEIAKMMIENNAIVVLEDLNWGFKRGRFKVERQVYQKFEKMLIDKLNYLSFKDVDTSDEGGILRGYQLTEPVANYTDIGKQTGFLFYIPAAYTSKIDPATGFVNHFNFNDITNAEKRKEFFMKMERIEMKNGNVEFEFDYRKFKTYQTDFQNVWTVNTSGKRIVFDTEKREHKAVYPTQEFVQAFGNKGITLEEGMDIKAFIGGIEADIKNASFFSSLFYAFKTTLQMRNSNADTREDYILSPVVHDGRQFCSTDEVNKGKDADGNWISKLPVDADANGAYHIALKGLYLLMNPQTKKIENEKWLQFMAEKPYKE

SEQ ID NO: 400 - protein, 1244 aa, synthetic construct
MYDLKQFIGIYPVSKTLRFELKPIGRTQEWIEKNHVLEHDWKRAEDYPRVKEMIDVYHKLCISKSLKNMDFDWEPLRDAIERNRQEKSDESKKELEAEQTRMRNKIHDQLSKFEHYKKLNADTPSLLINHILPQEDALESFKKFATYFEGFQKNRKNIYSKEAISTGVPYRLVHDNFPKFLANIEVFENLQELCPEVIRQAATEMAPFLQGVMIEDVFTVGFYNAILTQDGIDFYNQILGGVVKDEQHYQGINQLTNLYRQAHPDLTANRKSMTMVPLFKQILSDRETLSDIAKPIESEEQLIEVVTSFYHRVTDFTLNGNSINIIDELATLVQSLNTYNPEGIFVSAKSLTDVSHTLYGHWNKINEKLYEKAVELFGDVQVVKNRKKVEAYLNKDTYTLAELSFGDDISIAQYFENISGSADATNSLWVQFQSWCKTAEKPKFVHNEAGTELVKMLLDSILNVLHKCSVLVVSMENDLDKDFYNKFLPLYAELENVILLYNRVRNFLTQKPSSTGKIKLKFDIPSLGAGWGINKEKKNKAILLFKDGRSYLGIMNVKGTLDFDCKAEHGEPTYKKMVCVNHSKPYMDLPNSFFRQTGIDKYKPSERILKIYEAFKKDSKSVDINEVRELIDYYKDAITRNEDWNSVSFTYSPTETYETIDDFYKEVAKQSYQVSFKDISQKQVDEWVEKGQLYLFQLYNKDYAEGAHGRKNLHTLYWESLFTAENLSDIVIKLGSNAELFYRPQAIKKPVKHEVGTKMLNRRDNSGKPIPDTIYRSLYQFYNGKKAKAELTAEERAYISQVIVKDVQHEIIKDRRYTKQFHYQFHVPIVFNANANGKVKFNDKVMDYIQDNPDVNIIGIDRGERHLIYLTLINQRGEILKQKTFNVVGNYDYQEKLKQREKERNEARRSWQSVGKIKDLKEGFLSAVVHEIAQMMIEHNAIVVLEDLNRGFKRGRFKVERQVYQKFEKMLIDKLNYLSFKDREIADEGGILCGYQLTEKTLNYSDIGRQTGFLFYIPAAYTSKIDPVTGFVNHFNLNDITNAEKRKAFLMKMERIEVKNGNVEFEFDYRKFKTFQTDFQNVWTVNTSGKRIIFDTETRKAKDVYPTKEIAQSFANRGIALEEGMDLKAIIAEVEPDVKNAAFFKSLFYAFENTLRMRNSNTETQEDYILSPVAINGKQFCTTDEANKGKDADGNWLSKLPVDADANGAYHIALKGLYLLNNPQTKKIENEKWFQFMIEKLYLK

SEQ ID NO: 401 - protein, 1252 aa, synthetic construct
MKDLKQFIGIYPVSKTLRFELRPVGKTQEWIEKNRVLENDESKAADYPVVKKLIDEYHKVCIRESMKDVHLDWAPLKEAMEEYQKKKSDDAKKRLEAEQTMMRKRIATAIKDFRHYKELTAATPSDLITSVLPEFSDNEALKSFRGFASYFIGFQENRNNIYSPDAISTGVPYRLVHDNFPKFLSNLEVYDKIKATCPEVIQQASEEIQPFLEGVMIDDIFSLDFYNSLLTQDGIDFFNRVIGGVSEEDKQKYRGINEFSNLYRQQHKELAGSKKALTMIPLFKQILSDRDTLSYIPAQIETENELMTSISQFYKHITYFERDGKTINVLNELVALLSKIDTYNPDGICVTANKLTDISQKVFGKWSIIEENLKEKAVQQFCDISVAKNKKKVDAYLSRKAYCLSDLCFDDEFHISQYFSDLPQTLNAIEGYWLQFNEWCKNDEKQKFLNNPAGTEVVKSLLDAMMELSHKCSVLVMPEEYEVDKSFYNEFIPLYEELDTLFLLYNKVRNYLTRKPSDVKKFKLNFETPSLADGWDQNKERANKAILLFKDGLSYLGIMNAQNMPNLNQKWSADESHYSKMVYKLIPGPNKMLPKVFFSKKGLDIFNPSRHILRIKEEETFKKGSPNFKLADLHDLIDFYKDGINRHPDWSKFNFQFADTKAYEDIAGFYRDIANQAYKITFSDIPVWQINDWIDNGQLYLFQLYNKDYAEGAHGRKNLHTLYWENLFTDENLSNLVLKLNGQAELFCRPQSIKKPVSHKMGSKMLNRRDKSGMPIPESIYRSLYQFYNGKKKESELTAAEKQYMDQVIVKDVTHEIIKDRRYTRQEYFFHVPLTFNANAEGNEYINENVLNYLKDNPDVNIIGIDRGERHLIYLTLINQRGEILMQKTFNVVNSYNYQAKLEQREKERDEARKSWDSVGKIKDLKEGFLSAVIHEICKMMIENNAIVVLEDLNFGFKRGRFKVERQVYQKFEKMLIDKLNYLSFKDREAEEDGGILRGYQMAQKFVSFQRLGKQSGFLFYIPAAYTSKIDPITGFVNHFNFNDITNAEKRKEFLMKMERIEMRNGNIEFEFDYRKFKTFQTDYQNLWTVSTYGKRIVMRIDDKGYKQMVDYEPTKDIVNTFKNKGIQLTEGSDLKALIADIEANATNAGFFNTLLYAFQKTLQMRNSNAATEEDFIFSPVARDGRYFCSMDEANKGRDAQGNWVSKLPIDADANGAYHIALKGLYLLRNPETKKIENEKWLQFMVEKPYLE

SEQ ID NO: 402 - protein, 1277 aa, synthetic construct
MLNLNYYLFYFVSLWQDNEYLKPITMNNLKQFIGIYPVSKTLRFELRPIGKTQEWIEINKVLEGDVQKAADYPTVKKLIDEYHKICIHDSLKNVHFDWAPLKEAIVIFQKTKSDESKKRLEAEQTIMRKQIAAAIKDFKHFKELTAATPSDLITSVLPEFSDDDSLMSFRGFATYFSGFQENRINIYSQESISTGVPYRIVHDNFPKFLSNQEVYDRIRSVCPEVIKQASEELQPFLEGVMIDDIFSLDFYNSLLTQDGIDFYNRVIGGVSEEGKQKYRGINEFSNLYRQQHKDLAASKKAMTMIPLFKQILSDRETLSYIPVQIESEDELVSSIKQFYEHITHFERDGKTVNVLSELVAVLGNIDSYNPDGICISASKLTDISQKVYGKWSIIEEKLKEKAIMQYGDISVAKNKKKVDAYLSRKAYCLSDLCFDEVVSFSRYYSELPQMLNAINGYWMQFNEWCRSDEKQKFLNNPMGTEVVKCLLDAMMELYHKSAVLVMPEEYEVDKSFYNEFIPLYEELDTLFLLYNKVRNYLTRKPSDVKKFKLNFESPSLASGWDQNKEMKNNAILLFKDGKSYLGVLNAKNKAKIKDAKGDASSSSYKKMIYKLLSDPSKDLPHKLFAKGNLDFYKPSEYILEGRELGKYKKGPNFDKKFLHDFIDFYKAAIAIDPDWSKFNFQYSPTESYEDIGAFFSEIKKQAYKIRFTDITESQVNEWVDNGQLYLFQLYNKDYAEGAHGRKNLHTLYWENLFTDENLSNLVLKLNGQAELFCRPQSIKKPVSHKIGSKMLNRRDKSGMPIPENIYRSLYQFYNGKKKESELTTAEKQYMDQVIVKDVTHEIIKDRRYTRQEYFFHVPLTLNANADGNEYINEQVLNYLKYNPDVNIIGIDRGERHLIYLTLINQRGEIIKQKTFNIVNNYNYQVKLEQREKERDEARKSWDSVGKIKDLKEGFLSAVIHEITKMMIENNAIVVLEDLNFGFKRGRFKVERQVYQKFEKMLIDKLNYLSFKDREVGEEGGILRGYQMAQKFVSFQRLGKQSGFLFYIPAAYTSKIDPVTGFVNHFNFNDITNAEKRKDFLMKMERIEMKNGYIEFTFDYRKFKTYQTDYQNVWTVSTFGKRIVMRIDEKGYKKMVDYEPTNDIIYAFKNKGILLSEGSDLKALIADVEANATNAGFFGTLLYAFQKTLQMRNSNALTEEDFILSPVAKDGHHFCSTDEANKGRDAQGNWVSRLPVDADANGAYHIALKGLYLLRNPETKKIENEKWFQFMVEKPYLE

SEQ ID NO: 403 - protein, 1251 aa, synthetic construct
MKDLKQFIGIYPVSKTLRFELKPIGKTLEWIKKNKVLESDEQKAEDYPKVKTLIDEYHKVCICESLKGVNFDWNPLRLALKEYQSSKSDESKAVLEKEQALMRKQIATVIKDFRHYKELTTPTPQKLIDNVFPSIYESDALKSFNRFAVYFKGFQENRNNIYSSDAISTGVPYRLVHDNFPKFLADIEVFENIKTNCPEVIEQAATELQPFLEGVMIEDIFTIDFYNSLLTQDGIDFFNQVLGGVAEEGKQKYRGINEFSNLYRQQHPEQTAKKKTLTMIPLFKQILSDRDTLSYIPQQIESEQQLIELLNQFYSHITAFDYNGKTVDVLKELTKLTGNINKYNPDGIYLSAKSLTDVSQKLFSKWNVITERLSEEAIKRFGDVSITKNKKKIDAYLSKDAYALSEIPLDNDHSLSMFFAEFPKTIENVGSNWLQFMEWCKGESKQLFLNNADGTEIVKNFLDSIMEILHRCSVLVVSVEHDLDKDFYNDFLPLYAELENAVMVYNRVRNFLTKKPSDTKKFKLNFGVPSLGDGWDQNKERDNKAIILFKDGKSYLGIMNAKDMPIIKERDESTPSSYKKMIYKLLADPAKDFPHTFFSKKGIDTYHPSRYILDGREQGKYKKGETFDKKFMRDFIDFYKDAVAKHPIWSKFNFVYSPTESYEDIGAFFNEVSKQAYKIRFSYIEESQINEWTEKGQLYLFQLYNKDYAEGAHGRKNLHTLYWESLFSPENLSNIVLKLNGQAELFYRPQSIKQPFSHKTGSKMLNRRDKSGMPIPEAIYRSLYQYFNGRKAESELTLVEKSYIDQVVVKDVTHEIVKDRRYTKPEFFFHVPITFNVNADGNEYINEQVMEYLKDNPDVNIIGIDRGERHLIYLTLINQRGEILKQKTFNIVGNYNYHAKLEQREQERDQARKSWQSVGKIKELKEGFLSAVIHEIAMMMIKYNAIVVLEDLNFGFKRGRFKVERQVYQKFEKMLIDKLNYLSFKDRKPDEAGGILRGYQLTQQFTSFQRLGKQSGFLFYIPAAYTSKIDPVTGFVNHFNFNDITNAEKRKAFFMKMERIEMRNGDIEFEFDYRKYKTYQTDYQNIWTVNSSGKRIVMRIDENGRKQMTDYFPTKEIVKAFSDKNITLCEGTDLKALMAVIDTSPKNASLYGTLFYAFQKTLQMRNSDSATEEDYILSPVTQNGKQFNTKDEADKGQDSAGNWVSKFPVDADANGAYHIALKGLFLLMNQQTKKIENQKWLQFMVQKPYKS

SEQ ID NO: 404 - protein, 1249 aa, synthetic construct
MKDLKQFIGIYSVSKTLRFELRPIGKTQEWIEKNKILESDEQKAEDYPKVKTLIDDYHKVCIRESLRGVHLDWSPLRQALEEYQQTKSDESKAVLEKEQTSMRKQIAAAIKDFRHFRELTAPTPQKLIDDVFPGIYEDEALKSFNRFALYFRGFQDNRNNIYSAEAISTGVPYRLVHDNFPKFLADIEVYENIKATCPEVIEQVAVEMQPFLEGVMIDDIFTLDFYNSLLTQDGIDFFNQVLGGVAEEGKQKYRGINEFVNLYRQQHPELTGKKKALTMVPLFKQILSDRETLSYIPQQIESEQQLIDVLSQFYAHITDYEYNGKTINVLKELSNLTNRIGDYNPAGIFLSAKTLTDVSQKLFGRWSAINDKLYEKAVSQFGDPAIVKDKKKIDAYLAKDAFALSEINLDSEHHLSTYFSEMALVVEQVGSSWLQFKEWCKGSDKQLFLNNADGTEIVKNLLDAMMDILHRCAVLVVPIEYDLDKDFYNDFLPLYAELENVIFVYNRTRNYLTKKPSDTKKFKLNFGTPTLGDGWGVNNERKNKAILLFKEGLSYLGIMNVKGTLKFEETKDASLHSYKKMTCRYLSKPFMDLPHTFFSEKGISTFHPSERIMDIYKNGTFKKDSPSYSIAALHDLIDFYKDAINKHEDWVKYGFSFSPTESYEDISSFYSEIAKQAYKISFTNVSEQQVNDWVENGQLYLFQLYNKDYAEGAHGRKNLHTLYWENLFSEENLNNLVLKLGGQAELFYRPQSINKPAKHVVGSKMLNRRDKSGMPIPEPIYRSLYQYFNGKKQEDELTAAEKAYIDQVVVKDTNHEIVKDRRYTKPEYFFHVPIVFNANADGNEYINERVLDYLKDNPEVNIIGIDRGERHLIYLTLINQRGEILKQKTFNMVGNYNYHAKLELREKERDDARKSWKSVGKIKELKEGFLSAVIHEIAVMMVENNAIVVLEDLNFGFKRGRFKVERQVYQKFEKMLIDKLNYLSFKDRMADEEGGILRGYQLALQFTSFQRLGKQSGFLFYIPAAYTSKIDPVTGFVNHFNLNDITNAEKRKAFLMNMERIEVKNGNVEFEFDYRKFKTYQTDYQNIWTVNTSGKRIVFDSETRKAKDVYPTQEIIAAFKEKGINLNDGTDLKPLIADIEANAKNASFYYAIFDAFKRTLQMRNSNAATEEDYILSPVVCNGKQFCTTDEVNKGKDADGNWLSKLPVDADANGAYHIALKGLYLLNNPQTKKIENEKWFQFMVEKPYLE

SEQ ID NO: 405 - DNA, 3088 bp, synthetic construct
  source 1..3088: mol_type = other DNA
atgaaggacctgaagcaatttataggcctgtatccggtcagtaaaaccctgagattcgaattaaggcccgtcggacgtacacaggaatggatggagaagaatcatgtgctggagcacgatggcaaaagagcagaagattatccaagggttaaggaactaatagatgcctatcacaagatctgtattagcaattcgctcaaagtatctgacattaattggacgccacttcgggacgcaattgagaagaatcgacaggagaagagtgatgaaagcaaaaaggctctggaagaagaacagactaaaatgcgtctggagatttgtaagaagctcgccaaatttgagcactatcaggaactcgtgaaagccgacacaccttcaaaattaatcaacgggatactccctcacgataaagcgctggacacatttaacaagttcgctgtctactttgaaggctttcaggagaatcggcgaaatatctactctagcgaggcaatatcaaccggtgtcgcctaccgcctggtgcacgataacttccctaaattcctggcgaatatcgaggtcttcgaaaacataaaggaaatttgtccagaggttatacagcaagtggccactgagatggccccatttttggaaggagtgatgatcgaggatgtgtttaccgtaagttattataacgccgttctcacccagaacgggatcgactattacaaccaaatccttggtggcgttgcaaaggacgaccagaagtatcgaggtatcaacgaattcatcaacctttacagacaggctcatccagagctggccacaaaaaagaaaagcctgactatggtccctctatttaagcaaatattaagcgacagggagacactgagtgatattgtccgcccagtggaaagcgagaagcagttgatcgaagtaattaacaacttctaccagcgcatcactaactttgacattaacggtaagaacgtcaatgttgttaaggaattgacagatctggtcctgtcaatcgacacatacaatcctgagggaatctttatctccgctaagtccattaccgatgtgtctcattccctgtacgaccactggaaccgtatcaatgagaaactgtatgacaaagccgtggaagccataggaggggtgcaaactgtgaagaataagaagaaagtggaggcctatctgaaaaaagacgcatataccttgtccgaactgagtttcggggatgatgtatccatctcgcagtacttttctgcccttacgaacagtactgactccattaactccctgtggctgcaatttcaatcatggtgcaagtcagctgagaagcctcaattcgtccataacgaggtgggtactgagtatgtgaaaatgctactggatgctatcatgcttgtactgcacaaatgcggcgcgctgttggtgtccttggagaatgagctcgatagcgacttctacaataaattcctgcccttgtacgctgaattggagaatgttatcctggtctataccagagtacggaattttctaaccaaaaaactctccgacacgggtaagatcaaactcaaatttgatacgccctcactaggggccggatgggggattaacaaggagaaaacgaacaaggccgtgttactgtttaaggacggcctgagttatctgggcatcatgaatgtcaaaggaacattggactttaattgcaagatcgaagctgacgaacctacatttaagaagatggtctgccggaattattctaagccctatatggatcttcccaacagctttttcagccagaacggaatctctaagtttcacccttccgagcgaatccagaagatatatttcgccttcaaggagaactccaaaaatgttgacatcaaaaaggtgcatgagctcatcgactactacaaagatgctatctccaggcacgaggactggggctctttcggcttcaagtactcacccaccgaaagctatgagactattaatgacttctacacagaggtggcagcacagtcttataagcttcgctttatagaggtgccccaaaagcaggtggatgagtgggtcgaagaaggaaaactctacctgttccagttgtacaataaggactacgctgaaggtgcacatggcaggaagaatctccatacaatgtattgggagtgtctgttttctgaggaaaacttgtccaatctgttcataaagctcggggggcaggcagaattattttaccggcctcagtcaatcaagaaacccgtgagccataaagtcggcaccaagatgttgaatagacgggctaaagatggcaaaccgatcccggatgccatttacagatccctctatcaatacttcaatggaaagaaggccgaggcggaactgactacagaggaaaaagcctacatttctcaggttatcgtgaaggatgtgcaccatgagattattaaagatagacggtacaccaaacaattcttctatcagtttcacgttccaattgttttcaacgccaacgcaccacagcggcctaaaatcaatgaacgcgtactcgagtatattaaggagaacccggacgtaaatatcattggaatcgatcggggggaaaggcacttggtgtaccttaccctcattaaccaaaggggtgagatccttaagcagaaaacctttaacgtggttggcgactacaactatcaagaaaaactcaagcagagggagaacgagagagatcaggctcgcaagtcatggcagagcgtcgggaagattaaggatctcaaagaggggttcctgagcgccgttgtgcacgagattgccaagatgatgattgaaaacaatgccatagtggtgctcgaagacctcaattggggattcaaaagagggcggtttaaagtggagagacaggtttaccaaaagttcgagaagatgctgattgacaagctgaattacctgagtttcaaagacgtggacacatctgacgagggcggaatcctacgaggctatcagctgacagagccagtggccaactacactgatataggcaaacagactgggttccttttctacatccccgctgcttataccagtaaaattgaccctgcta

SEQ ID NO: 406 - DNA, 650 bp, synthetic construct
  source 1..650: mol_type = other DNA
ccggattcgtgaaccacttcaatttcaatgatatcaccaatgccgaaaaaaggaaggagtttttcatgaaaatggagcgcattgaaatgaaaaatggtaacgtagagttcgagtttgactaccgcaagtttaagacctatcagacggatttccagaatgtatggaccgtcaacacatcaggcaagcgcattgtgttcgacactgaaaagcgagaacataaggctgtgtacccaactcaggagtttgtgcaggcttttggcaacaaaggcatcacccttgaggaaggaatggacattaaggcattcataggtgggattgaggccgacattaagaacgcctcttttttttcgagtctgttctacgcgtttaaaactacacttcagatgaggaacagcaatgcggataccagggaagattatatccttagccccgtcgtccacgacgggcgtcagttttgcagcaccgatgaggtgaacaagggaaaagatgcagatgggaactggatttctaagttacccgtggacgcagatgcaaacggcgcgtaccatatcgctctaaaaggcctgtacctgctcatgaatccccagactaagaagatcgagaatgaaaagtggttacagttcatggcagagaaaccatacaaggaatga

SEQ ID NO: 407-410 - skipped (4 entries)

SEQ ID NO: 411 - DNA, 36 bp, synthetic construct
  source 1..36: mol_type = other DNA
atctacaatagtagaaatttaatatggtcttacacc

SEQ ID NO: 412 - DNA, 36 bp, synthetic construct; identical to SEQ ID NO: 411
  source 1..36: mol_type = other DNA

SEQ ID NO: 413 - DNA, 36 bp, synthetic construct
  source 1..36: mol_type = other DNA
gctgtaagagcatattaaatttctactattgtagat

SEQ ID NO: 414 - DNA, 36 bp, synthetic construct; identical to SEQ ID NO: 413
  source 1..36: mol_type = other DNA

SEQ ID NO: 415 - DNA, 36 bp, synthetic construct
  source 1..36: mol_type = other DNA
ggtgtaaaccatagtaaaatttctgctattgcagat

SEQ ID NO: 416 - DNA, 36 bp, synthetic construct; identical to SEQ ID NO: 415
  source 1..36: mol_type = other DNA

SEQ ID NO: 417 - DNA, 36 bp, synthetic construct
  source 1..36: mol_type = other DNA
atctgcaatagcagaaattttactatggtttacacc

SEQ ID NO: 418 - DNA, 36 bp, synthetic construct; identical to SEQ ID NO: 417
  source 1..36: mol_type = other DNA

SEQ ID NO: 419 - DNA, 36 bp, synthetic construct
  source 1..36: mol_type = other DNA
ggtgcaaatacatataaaatttctactattgtagat

SEQ ID NO: 420 - DNA, 36 bp, synthetic construct; identical to SEQ ID NO: 419
  source 1..36: mol_type = other DNA

SEQ ID NO: 421 - DNA, 36 bp, synthetic construct
  source 1..36: mol_type = other DNA
gctgttagagcatatgaaatttctactatcgtagat

SEQ ID NO: 422 - DNA, 36 bp, synthetic construct; identical to SEQ ID NO: 421
  source 1..36: mol_type = other DNA

SEQ ID NO: 423 - RNA, 36 nt, synthetic construct
  source 1..36: mol_type = other RNA
ggtgtaagaccatattaaatttctactattgtagat

SEQ ID NO: 424 - RNA, 36 nt, synthetic construct
  source 1..36: mol_type = other RNA
gctgtaagagcatattaaatttctactattgtagat

SEQ ID NO: 425 - RNA, 36 nt, synthetic construct
  source 1..36: mol_type = other RNA
ggtgtaaaccatagtaaaatttctgctattgcagat

SEQ ID NO: 426 - RNA, 36 nt, synthetic construct; identical to SEQ ID NO: 425
  source 1..36: mol_type = other RNA

SEQ ID NO: 427 - RNA, 36 nt, synthetic construct
  source 1..36: mol_type = other RNA
ggtgcaaatacatataaaatttctactattgtagat

SEQ ID NO: 428 - RNA, 36 nt, synthetic construct
  source 1..36: mol_type = other RNA
gctgttagagcatatgaaatttctactatcgtagat

SEQ ID NO: 429 - protein, 1280 aa, synthetic construct
  VARIANT 145: note = X is independently selected from any naturally occurring amino acid or absent
  VARIANT 228: note = X is independently selected from any naturally occurring amino acid or absent
  VARIANT 594: note = X is independently selected from any naturally occurring amino acid or absent
  VARIANT 645: note = X is independently selected from any naturally occurring amino acid or absent
  VARIANT 857: note = X is independently selected from any naturally occurring amino acid or absent
MLNLNYYLFYFVSLWQDNEYLKPITMKDLKQFIGIYPVSKTLRFELRPIGKTQEWIEKNKVLEXDEQKAEDYPXVKXLIDEYHKVCIXESLKXVHFDWAPLRXAIEEYQQXKSDESKKXLEAEQTXMRKQIAXAIKDFRHYKELXTAXTPSKLIXSVLPXXXXDDALKSFNXFAXYFEGFQENRNNIYSSEAISTGVPYRLVHDNFPKFLANIEVXENIKXTCPEVIXQAATEMQPFLEGVMIXDIFTLDFYNSLLTQDGIDFXNQVLGGVAEEGKQKYRGINEFSNLYRQQHPELXAKKKALTMXPLFKQILSDRETLSYIPQQIESEQQLIEVIXQFYXHITDFEXNGKTXNVLKELXALXGXIDTYNPDGIFXSAKSLTDVSQKLXGKWXIINEKLYEKAVEQFGDVSVVKNKKKVDAYLSKDAYXLSELXFDDDXSISQYFSELPQXLXAINSXWLQFXEWCKXXEKQKFLNNXXGTEXVKXLLDAXMEXLHKCSVLVVXEEYXLDKDFYNXFLPLYAELENVILXYNRVRNXLTKKPSDTKKFKLNFXTPSLGDGWXQNKERKNKAILLFKDGLSYLGIMNXKGTLXFXBXKXEAXESSYKKMVXKLLSKPYXDLPHXFFSKKGIDXXHPSERILXIYEXGXFKKGSPNFDIKFLHDLIDFYKDAIXRHXDWSKFNFQYSPTESYEDIGXFYSEXAKQAYKIRFXDIXEXQVNEWVENGQLYLFQLYNKDYAEGAHGRKNLHTLYWENLFXXENLSNLVLKLXGQAELFYRPQSIKKPVSHKVGSKMLNRRDKSGMPIPEAIYRSLYQXXNGKKAESELTAAEKAYIDQVIVKDVTHEIIKDRRYTKQEYFXFHVPIXFNANADGNEYINEXVLXYLKDNPDVNIIGIDRGERHLIYLTLINQRGEILKQKTFNVVGNYNYQAKLEQREKERDEARKSWQSVGKIKDLKEGFLSAVIHEIAKMMIENNAIVVLEDLNFGFKRGRFKVERQVYQKFEKMLIDKLNYLSFKDREADEEGGILRGYQLXQKFXSFQRLGKQSGFLFYIPAAYTSKIDPVTGFVNHFNFNDITNAEKRKAFLMKMERIEMKNGNXEFEFDYRKFKTYQTDYQNVWTVNTSGKRIVXXXXDXXXXKMKDXYPTKEIVQAFKNKGITLEEGXDLKALIADIEANAKNASFFGTLFYAFQKTLQMRNSNAATEEDYILSPVAXBGKQFCXTDEANKGKDADGNWVSKLPVDADANGAYHIALKGLYLLXNPQTKKIENEKWXQFMVEKPYLE

SEQ ID NO: 430 - DNA, 3738 bp, synthetic construct
  source 1..3738: mol_type = other DNA
atgaaagacctaaaacaattcatcggcttatatcctgtatcaaagacattgcgctttgagttgagacctgtgggcagaacgcaggagtggatggaaaagaatcatgtgttggaacatgatggcaaaagggctgaggattatcccagagtgaaggaactaatagatgcttaccacaaaatatgcatcagcaactcgttgaaagtgtctgatattaattggactccgttgcgagatgccattgaaaagaatcgccaagagaagtctgacgagtcaaaaaaggcattggaggaagagcaaaccaagatgcgccttgagatatgcaagaagctggctaagtttgaacactatcaggaactggtaaaagccgatacgccatctaagcttattaacggtattcttcctcatgataaggctttagatacgttcaacaagtttgctgtttactttgagggctttcaggagaacaggagaaatatctatagtagtgaagctatcagtacgggcgttgcttatagacttgttcacgataatttcccaaagttcctggccaatattgaggtgtttgaaaacatcaaggagatttgtccagaagtcatccaacaggtagctacagaaatggctccattccttgaaggtgttatgattgaggatgtatttactgtcagctactataatgccgttttaactcaaaatggtatagattactataaccagattctgggcggagtggcaaaagatgatcagaagtatcgtggcatcaatgagtttataaacttataccgtcaggctcatccagagttggctacaaagaagaagtcgctaacgatggtgccactcttcaagcagattttgtcagacagagaaacactttcagatatagttcgccccgttgaatcagagaaacagctgatagaggtgataaacaatttctatcaacgcattactaactttgatattaatggaaagaatgtcaacgtcgttaaagaactgaccgatttggttttaagtattgatacgtataaccctgaaggtatctttatttcagccaaatcaataaccgatgtatctcattccttatatgaccattggaatagaattaacgagaagctttatgacaaggctgtggaggcaattggaggtgttcagacagtgaagaacaaaaagaaggtggaggcttatttgaaaaaagatgcctatacgctttctgaactgagctttggcgatgatgtttctatctctcagtatttctctgcattaacgaattccactgactccatcaatagcttatggttgcaatttcagagttggtgcaagtcggcagagaaaccacaattcgtccataatgaggttggtacggaatacgtaaagatgctgttggatgctatcatgcttgtattgcacaagtgcggagcacttctggtatccttggaaaacgaattggacagcgacttctataacaagttcctgccgctctacgcagaactggagaatgtgatattggtttatacaagagtaaggaacttcctcaccaagaagctttctgatacaggcaagataaagctgaagttcgatacaccctcgcttggtgctggatggggcatcaataaagagaagacgaataaagctgtattattgttcaaggacggattatcatatctgggtattatgaacgtcaaaggcacgttagactttaattgcaagatagaagctgacgagccgacgttcaagaaaatggtttgcagaaactattccaaaccttacatggacctgcctaattcattcttcagccagaacggaataagcaagttccacccgtctgagcgaatccaaaagatatattttgcattcaaagagaattcaaaaaacgttgatatcaagaaggtgcacgaactgatagattactacaaagatgctatcagtcgccatgaagattggggatcatttggctttaagtattctcccacagaatcctacgagaccatcaatgatttctatacagaggtggctgcgcaatcatacaaacttcgtttcatagaagttccccaaaaacaagttgacgagtgggttgaagaaggaaaactctacttgttccaactatataacaaagattatgcagagggcgctcatggtcgcaagaatcttcacacgatgtattgggagtgcctcttctctgaagaaaatctcagcaacctgttcatcaagttgggaggtcaggcagaattgttctatcgcccacaaagcatcaagaaaccagtatcacataaagttggcacgaagatgctgaatcgcagagcgaaggacggaaagcctataccagatgctatatatcgtagtctctatcagtatttcaatggcaagaaagcggaagcagaactgaccacagaagaaaaggcctatatcagccaggtcatcgtgaaggatgtgcatcacgaaatcatcaaggacagacgttacaccaagcagttcttctatcaattccacgtgcctatcgtgtttaatgcaaatgctccccaaagaccgaagattaatgagagggttttggaatacatcaaggagaatccagacgtaaacatcatcggaatagaccgtggtgagcgccacttggtttatcttacccttatcaatcagcgaggagagattctgaagcagaagaccttcaacgttgttggcgattacaactatcaggagaaactaaagcagcgcgaaaatgaacgagaccaagcgcgaaagagctggcagagcgtaggtaaaatcaaggacctgaaagaaggtttcctttctgctgttgtgcatgagatagccaagatgatgatagaaaataatgccatcgtggttcttgaagacctgaattggggattcaagcgtggccgtttcaaggtggaacgccaggtgtatcagaaattcgagaagatgctgattgacaaactgaactacctgtcgttcaaagatgtagatacgtcagatgaaggtggcattcttcgtggttaccaattaacagagccggtggctaactatacggatattggcaaacaaacgggcttccttttctatattcctgctgcctatacgtcaaagattgatcctgcaacggggtttgttaaccacttcaacttcaacgacatcaccaatgccgagaagcgcaaagaattcttcatgaagatggagcggattgagatgaagaacggcaacgtggagtttgagtttgactatcgcaagttcaaaacctatcagacggacttccagaacgtgtggacagttaatacctctggtaagcgtatcgtcttcgatactgagaagagggagcacaaagctgtttatcctacgcaggaatttgtgcaggcttttggcaataagggtataacgcttgaagaaggaatggatatcaaggcgtttattgggggaatcgaagctgacatcaagaatgcgtcattcttcagttcactcttctatgcgttcaagactactctgcagatgcgtaacagtaatgccgatacaagagaggactatatcctttcgcccgtagttcatgacggcaggcagttctgttctacagacgaagtcaacaagggcaaggacgcagacggcaattggatatcaaaactacctgtagatgccgatgccaatggtgcataccacatcgctctgaagggtctctacctactaatgaacccgcaaacaaagaagatagaaaacgaaaaatggctccagttcatggccgaaaagccgtataaggagtaa

SEQ ID NO: 431 - DNA, 3735 bp, synthetic construct
  source 1..3735: mol_type = other DNA
atgtacgacctgaaacaatttatcggcatatatccagtttcaaagacgttgcgctttgagttgaaacctattggcagaacgcaggaatggatcgagaagaatcatgtgctggaacatgattggaagagggctgaggattatcccagagtgaaggagatgattgatgtttaccacaaattgtgcatcagcaagtcgttgaaaaacatggattttgactgggaacccctgcgcgatgcaattgagcggaatcgtcaggagaagtcagacgaatcgaagaaagaattggaggcagagcagaccaggatgcgcaacaagatacatgatcagttatcaaaatttgaacattacaaaaagctcaacgccgatacgccatcgttgctgattaatcacattctgccccaagaagatgccttggagagcttcaagaagtttgctacgtattttgagggatttcagaagaacagaaagaacatttacagcaaggaggccatcagtactggtgtaccataccgacttgtacacgacaacttccctaagttcttagcaaacattgaggtctttgaaaacttacaggagctctgccctgaagtcattcggcaggccgctacagaaatggcaccttttctgcaaggagtcatgatagaggatgtatttaccgtcggcttttataacgctatactgacgcaagatggcattgatttttataatcagattctgggtggagtggtaaaagacgaacaacactatcaaggtattaaccaattgacgaatctctacagacaggctcatccagaccttaccgccaataggaaatcgatgacaatggtgccgctcttcaagcagattctgtcagaccgcgaaacgctttcagatattgccaagcctatcgagtcggaagaacaactgatagaggttgtaaccagtttctaccatcgcgttacggatttcacactcaacggaaacagcatcaacatcatcgacgagctagcgactctcgtgcaaagtctcaatacctataatcctgagggaatattcgtttcggctaagtcattgacagatgtctctcatacgttgtatgggcattggaacaagatcaacgaaaaactctatgaaaaggctgtcgaattgtttggtgatgttcaggtggtcaaaaacagaaagaaggtagaggcttatctgaacaaagacacatacacactcgcagaactgagtttcggcgacgatatttccattgcacaatacttcgaaaacatctctggttccgctgatgccacaaacagcctttgggtacaattccaaagctggtgcaaaacggcagagaagccaaaattcgtacacaacgaggctggtacagaactcgttaagatgctgttggattccatcttgaacgtactgcacaaatgctcagttttggttgtatcgatggaaaacgacttagacaaagacttctacaataagttcttgcctctctatgctgaattggagaatgtgatattgttatataacagggtgcgaaatttcctcacgcagaagccatcgagtacgggcaagataaaactgaagttcgacatcccttcgcttggcgctggttggggcatcaacaaggaaaagaagaataaggcaatattgctattcaaagatggacgttcttatcttggcattatgaatgttaaaggaacgttagattttgactgcaaagcagaacatggcgagcctacatacaagaaaatggtttgcgtaaaccattccaagccttacatggatttgcccaattcattcttccgtcaaacaggcattgacaagtataagccttcagagcgcatcttgaaaatctatgaggcatttaagaaagattcaaagagtgtagatatcaatgaggtgagagaacttatagactattacaaggatgctatcaccagaaatgaagactggaattctgttagcttcacttattctcccacggaaacctatgaaaccattgacgacttttataaggaggtcgccaaacaatcctatcaagtcagttttaaggacatatcccaaaaacaggttgacgaatgggttgaaaaggggcagttatatctcttccagctttacaacaaagattatgcagaaggtgctcatgggcgcaagaatcttcataccctgtattgggaaagtctctttactgctgagaatctaagcgacatagttataaagctgggaagcaacgcagaattattctatcgtccgcaggccattaagaaacctgtaaaacacgaggtaggcacaaagatgctaaaccgcagggataatagcggaaagcctatacctgataccatctatcgtagcctctatcagttctacaacggcaagaaagcaaaagcagaactgacggcagaagagcgtgcttacatcagtcaggtgatagtgaaagacgtgcagcacgaaatcatcaaggaccgccgatacaccaagcagttccactaccagttccacgtacctatcgtgtttaatgcgaatgccaatgggaaggtcaagttcaacgacaaggtgatggactacatccaggataatcctgatgtcaacatcatcggaatagaccgtggtgagcgtcatctgatttatctgacattaataaaccaacgcggcgagattctgaagcagaaaacctttaatgtggtaggcaactatgactatcaggagaagctgaagcagcgtgagaaggagcgcaacgaagcccgtagaagctggcagagcgtaggtaagattaaggatctgaaagaaggttttctgtcagctgtggttcacgagatagcccagatgatgattgaacataacgcaatcgtcgtgctcgaagacctgaatcgcggttttaagcgcggccgcttcaaggtggaacgtcaggtgtatcagaagtttgagaagatgctgatagacaagctgaactatctgtcgttcaaagaccgcgagattgctgatgaaggcggcatcttgtgtggttaccaactgacggaaaagacattgaactactctgacattggtcgccagactggattcttgttctacattcctgcagcctacacgtcgaagattgaccctgtaacggggtttgtcaaccacttcaacctgaacgacatcaccaatgccgaaaagcgcaaagcattcctaatgaagatggagcgcatcgaggtgaagaacggcaacgtggagtttgagttcgactatcgtaagttcaagacgttccagacggatttccaaaatgtgtggactgtcaatacctcaggcaagcgcatcatattcgacacagagacgcgaaaagcgaaggatgtttatcctacaaaagagattgctcagtcttttgccaatagaggcattgctcttgaagaaggaatggacctgaaagcaatcattgcagaggttgagccggatgtcaagaatgctgcgttctttaagtctttgttttatgcatttgaaaacaccttgcgaatgcgtaatagcaatactgaaacgcaagaagattatatcctgtcgccagtcgctatcaacggcaaacagttctgcactacggacgaagcaaacaagggtaaggatgccgatggcaattggctttccaaactccctgttgatgccgacgccaatggtgcctatcacattgccctcaagggtctctacctgctaaataaccctcaaacaaagaagatagaaaacgaaaaatggttccaatttatgattgaaaagctctatttaaagtaa

SEQ ID NO: 432 - DNA, 3759 bp, synthetic construct
  source 1..3759: mol_type = other DNA
atgaaggacttaaaacaatttatcggcatatatccagtatcaaagactttgcgctttgagttaaggcctgtaggcaaaacccaggaatggatagaaaagaacagggtgttggaaaatgatgagagtaaggctgcggattaccctgtggtcaagaaactcattgacgagtatcataaggtttgcattcgcgaatccatgaaagatgtccatcttgactgggcacctctaaaggaggccatggaggaatatcagaagaagaaaagcgatgatgccaagaaacgcctggaggcagaacagacgatgatgcgcaaacgaattgctactgcaatcaaggatttcagacattacaaggaactgacggcagcaactcccagcgatttgattacatcagtattgccagagttcagtgataatgaggctttgaaatcatttcgaggattcgcttcctatttcataggcttccaagagaatcggaacaacatctatagtcctgatgctatcagtacgggtgtcccatatagattggtgcatgacaatttccccaaattcttatccaatctggaagtttatgataagatcaaggccacttgtcctgaggtcatccaacaggcatcagaggaaatacagcctttcttggagggtgtgatgattgatgatatcttctcgcttgatttttataactctctgctaacacaggatggcattgacttctttaaccgtgtgattggtggtgtgagcgaagaggataagcagaaatatcgtggcatcaacgagttctctaacctctatcgccagcagcataaggaactggctggttccaagaaggccttgacgatgattccattgtttaagcagatcttgtctgatcgtgacaccttgtcatatatccctgctcagatagaaacggaaaatgaactcatgacctctataagccaattctataagcacatcacctatttcgagcgtgatggaaaaaccatcaacgtactaaatgaattggtggctctgctaagcaagattgatacttataatccagatggtatttgtgttacagctaacaaactgactgatatctcgcagaaggtattcggcaagtggagtatcatcgaagagaatctgaaggaaaaggctgtccagcaattttgcgacatctctgtagccaagaataagaaaaaggtggatgcctatctttcgcgtaaggcttattgtctttctgacttgtgctttgatgacgagttccatatttcccaatatttttcagatcttcctcaaacgctcaatgccattgaaggctattggctgcagtttaatgaatggtgcaaaaacgatgaaaagcagaagttcctgaataatccagcgggtacggaagttgtgaagagcctcctggatgccatgatggaactctctcacaaatgttccgttctggtgatgccagaagagtatgaggtggacaagagtttctataatgagttcatccccctttatgaggaacttgacacgctcttccttttatataataaggtaaggaactaccttactcggaagccttctgatgtcaagaagttcaaactcaactttgaaactccatcattagctgacggatgggatcagaacaaggaaagagctaacaaggctattctgcttttcaaagacgggttatcctatttgggaatcatgaatgcccagaacatgccaaacctgaatcaaaaatggtcagcggatgaaagccattatagtaagatggtttacaaactgatacctggtcctaacaagatgttgccaaaggtgttcttctccaagaaaggactcgacatattcaatccgtccagacatatcttgagaatcaaggaggaagagaccttcaagaaaggctctcccaatttcaaacttgctgacctgcatgacctgattgatttctataaagatgggattaaccgtcatccggactggagcaagttcaatttccagtttgctgatactaaggcgtatgaggatattgcaggtttctatcgtgatatagctaatcaggcatacaagattacattctcggatatccctgtctggcaaatcaacgactggattgataatggccagttatatctgttccaactctataataaggactatgctgagggcgctcacggacgaaagaatcttcatacactctattgggaaaatctattcacagacgagaatctcagcaacctggtgctgaaactaaatggccaggcggagttgttctgtcgccctcaaagcattaagaaacccgtatcgcataagatgggctcgaagatgctcaatcgtagggacaagagtggaatgccgataccagaatccatctatcgcagcctgtatcagttctataatggcaagaagaaagaaagcgaactgacagctgcagaaaagcagtatatggatcaagtcatcgtgaaggatgtcacccacgagattatcaaagatcgcagatataccagacaggaatacttcttccatgtacctcttacattcaatgcgaatgcagaaggtaatgagtatatcaatgagaatgtgctgaattatctgaaagacaatcctgatgtgaatatcattggtatcgatcgtggtgagcgtcatctcatctatctcacactgattaatcagcgtggagaaatcttaatgcagaagacgttcaacgtagtgaatagctacaattaccaggcaaagttggagcagcgcgaaaaagaacgtgacgaggcccgtaagagttgggatagtgtaggtaaaatcaaagacctgaaagaaggtttcctttctgctgttatccacgagatttgcaagatgatgatcgaaaacaatgccatcgtggtattggaggatttgaactttggattcaaacgcggtcgtttcaaggtagagcgtcaggtctatcagaagttcgaaaagatgctgattgataaactgaactatctttcctttaaggatcgtgaggccgaagaggatggtggtatactcagaggctatcagatggcacagaagtttgtcagcttccagagacttggtaagcagagcggcttcttgttctatatccctgctgcctatacctcaaagatagatcccataactggttttgtgaatcatttcaactttaacgatatcacaaatgctgagaagcgaaaagaattcctgatgaagatggaacgcattgagatgagaaatggaaatatcgagtttgaattcgactatcgtaagtttaagactttccagacggactatcaaaacctttggacggtcagtacctatggtaagcgaatcgtgatgcgaatagacgataaaggatataaacagatggttgactacgagccaacaaaggatattgtcaatacctttaagaacaaaggcatacaactgacagaaggttctgatcttaaagccctgattgctgatattgaggctaatgctaccaatgctggctttttcaacaccttgctttatgcattccagaagaccttgcagatgcgtaatagcaatgctgcaacggaagaagattttattttctcgccagtagccagagacgggcgctacttctgcagtatggatgaggctaacaagggcagagatgcacaaggcaactgggtatcaaagcttcctattgatgcagatgcgaatggtgcctatcatattgctttgaagggactatacttgctcagaaatccagaaacgaagaaaatagaaaacgaaaaatggctccaatttatggtagagaaaccgtatttggagtaa

SEQ ID NO: 433 - DNA, 3834 bp, synthetic construct
  source 1..3834: mol_type = other DNA
atgctcaatttgaattattatctattttattttgtatctttgtggcaagataatgaatatttaaaacctattacaatgaacaacttaaaacaatttatcggcatatatcctgtttcaaagaccttgcgctttgagttgagacctattggtaagacacaagaatggatagaaattaataaggttttagaaggtgatgtacagaaagccgcagattatcctacggtcaagaagcttattgatgagtaccataaaatttgtattcatgactctttaaaaaacgttcactttgattgggctcctttgaaagaagctattgtcatttttcaaaagaccaagagtgacgagtccaagaaacgacttgaggcagagcagaccatcatgcgtaaacagattgctgctgcaatcaaggatttcaagcatttcaaggagttaacagctgcaacccccagcgatttgattacctcagtccttcctgaattcagcgatgatgactcattgatgtctttccgtggctttgctacctatttcagcgggtttcaagagaacagaattaatatctatagtcaggaatccatcagtacgggagttccttatagaatagtacatgataactttcctaagttcctttctaaccaggaggtctatgacagaatcaggtctgtatgcccagaagttatcaagcaggcatcagaagagttacagccttttttagaaggggtaatgatcgacgatatattttcacttgatttctataattctctattgactcaggacggaatagatttctataaccgtgtaattggtggtgtgagcgaagaaggtaaacagaaatatcgtggaatcaacgagttctcaaatctctatcgtcaacagcacaaagatcttgcagcctccaagaaggctatgacgatgatacctcttttcaaacagattttgtctgatcgtgaaactttgtcatacattcctgtacagatagaatcagaagatgagctagtatcttctatcaaacaattctatgagcatattacccacttcgagcgggatggaaaaacggtcaatgtgctatcagaattggtggctgtgctggggaatatagactcatataatcctgatggtatatgtatatcagccagcaaactgacagacatatctcagaaggtatatggcaagtggagcattatcgaagagaaactgaaagaaaaggctatcatgcagtatggtgacatctctgtagccaagaataagaagaaagtagatgcatatctttcacgtaaagcctattgcttgtctgatttgtgttttgacgaggttgtcagtttctcacgctattactctgaattaccacaaatgctcaatgctattaatggctattggatgcagtttaacgaatggtgtaggagtgatgaaaaacagaagttccttaataacccaatgggtactgaagtggtgaagtgtctgttagatgcaatgatggagctataccataagagcgcagtcttggtaatgccagaagagtacgaggttgacaagagtttctataacgaattcatacccctctatgaggaacttgatacactcttcctgttatataataaggtaaggaattacctcactcgaaaaccatctgacgttaagaagtttaaactaaattttgagtcgccttcattggcaagtggatgggaccagaataaggaaatgaagaataacgcgattcttcttttcaaggatggtaaatcgtatttaggtgttttaaatgccaagaacaaagcaaagataaaagatgccaagggcgatgcgtcatcttcttcatataaaaaaatgatttacaaacttctgtctgatccgtcaaaggatctgccccataagttattcgctaagggtaatcttgatttctacaagccatcagagtatatcttagaaggaagggaattgggtaaatacaagaaaggaccaaattttgacaagaagttccttcatgactttatagatttctacaaggcggcaattgctattgatcctgattggagcaagttcaacttccagtattctccaacggagtcgtatgaggatattggtgccttctttagtgaaatcaagaagcaggcttacaagattcgttttactgatataacagagtctcaggtgaacgagtgggttgataatggtcagttgtatctgttccagctgtataataaggattatgcagaaggggctcatggacgaaagaatctgcatacactctattgggagaatctttttactgatgagaatttgagtaatctggttctgaaactaaatggtcaggcagaattgttctgccgtcctcagagtatcaagaagcctgtgtcgcataagattggttcgaagatgctgaatcgtagggataagagcggtatgcccataccagaaaatatctatcgcagtttgtatcagttctataatggtaagaagaaagagagtgagctaacaactgcagaaaagcagtatatggatcaggtgatagtgaaggatgttacccacgaaatcattaaagaccgcagatacaccaggcaagaatacttcttccatgtacctctgacgttaaatgccaatgctgatggtaatgagtatattaatgagcaagtgctgaactatctgaagtataatcctgacgtgaatatcataggtattgaccgtggtgaacgtcatctgatttacctcacattgattaatcagcgtggagaaatcataaagcagaagacttttaacattgtgaataattacaactatcaggtcaagttggaacagcgagaaaaagaacgcgacgaggctcgtaaaagttgggatagtgttggtaaaataaaggatttgaaagaaggctttctttctgccgttatccatgagataactaagatgatgattgaaaacaatgccatcgtggttcttgaggatttgaactttggtttcaaacgtggtcgttttaaagtggagcgtcaggtatatcagaagttcgagaaaatgctgatagataagctgaattatctgtcatttaaggatcgtgaggtaggcgaagaaggaggtatacttagaggttaccagatggcacagaagtttgttagtttccagagattaggtaaacagagtggtttcttgttctatattcctgcagcttatacctccaagatagaccctgtgacaggctttgtaaatcatttcaacttcaacgatatcaccaatgcagaaaagcgaaaagacttcttgatgaagatggagcgcattgagatgaagaatggatatatagaatttacattcgactatcgtaagtttaagacttaccagacagactatcaaaacgtttggaccgtaagtactttcggaaaacgaattgtgatgcgaatagacgaaaaaggatataaaaagatggtggattacgaaccaacaaacgatattatttatgcctttaagaacaaaggcatcctgttgtctgagggttctgatttaaaggcgctcattgcagatgttgaggccaatgctactaatgcaggcttctttggcacgctgctctatgcattccaaaagactctacagatgcgtaacagcaatgctttaacggaagaagatttcatcctttcacctgtagcaaaagatgggcatcacttctgcagcactgatgaggcaaacaaaggcagagatgcgcagggcaactgggtatcaaggctacctgtagatgcagatgcaaatggcgcatatcacatcgctttgaagggactttatctgctccgaaaccctgaaacgaagaaaatagaaaacgaaaaatggttccagtttatggttgagaaaccatatttggagtaa

SEQ ID NO: 434 - DNA, 3756 bp, synthetic construct
  source 1..3756: mol_type = other DNA
atgaaggatttaaaacaatttatcggcatatatccagtctcaaaaacattacgttttgagttgaagccaattggtaaaacacttgaatggataaagaagaacaaagttcttgaaagtgatgagcaaaaagctgaggactatccaaaagtgaagacattgattgatgaatatcacaaagtctgcatttgtgagtctttgaaaggagtcaattttgactggaatccacttagattggctttgaaagaataccaaagtagcaagagtgatgagagcaaagccgttttggagaaagaacaagcattaatgcgtaaacagattgccacagtcatcaaggactttcgacactataaggaacttactacccccacaccacagaaacttattgataatgttttccctagcatttatgagagtgatgccttgaagtcattcaacagatttgccgtttatttcaaaggtttccaagagaatcgtaacaacatttatagctcagatgctattagtactggtgtaccttatagacttgttcacgacaattttccaaagtttttggcagacattgaagtctttgagaatatcaagacgaactgccctgaggtcatagaacaggcagcaacagaattacagccattccttgaaggagtaatgattgaggatatttttacgattgatttctacaactcccttctaactcaagatggtatagatttctttaatcaagtattgggtggagtagcagaagaaggcaagcaaaagtatcgcggcatcaacgagttctccaatttgtatcgtcaacaacatcctgagcaaacagcaaagaagaaaaccctcaccatgattccgcttttcaagcagatactttcagatagggatacgctttcttacattccacagcagatagagtcagaacaacaattgatagaactattaaaccagttctattctcacatcacggcctttgactataatggcaagactgttgatgttcttaaagaattgaccaaattaactggcaatatcaacaaatacaaccctgatggcatatatctttctgccaagtcattgacagacgtttcgcaaaagttgtttagtaaatggaacgtcattacagaaaggctttctgaagaggcaataaaaagatttggggatgtatcgataactaaaaataaaaagaagattgacgcttatctgtcgaaagatgcttatgcgctttcagaaatacccctcgacaatgaccattcattgtcaatgttctttgcagagtttcccaaaaccatagaaaatgttggcagcaactggctacaatttatggaatggtgcaaaggagagagtaagcaactcttcctcaataatgctgatggtacagaaatcgttaagaacttccttgattctattatggaaatcctacatagatgttctgtgcttgtggtttctgtagagcatgatttagacaaagatttctataatgatttcttgccactttatgcagaattagagaatgcagtaatggtttataatcgtgtacgcaatttcctgacgaagaagccttctgatacaaagaaatttaaattgaattttggtgtaccttcgttaggagatggttgggaccagaataaagagcgagacaacaaggccattattcttttcaaagatggtaaatcttatttgggcatcatgaacgcaaaggatatgcctataataaaagaaagagatgaaagcactccatcatcttataagaagatgatatacaaattgctcgctgaccctgccaaggattttccgcatacattcttttcgaaaaaaggaatagacacatatcatccttcaagatatattcttgacggacgtgagcaaggaaaatataagaagggggaaactttcgataaaaagttcatgcgggattttattgatttctataaggatgctgtggcgaagcaccctatttggagtaaattcaatttcgtctattctcctactgagtcatacgaagatataggtgctttcttcaatgaggtgtctaagcaagcatacaagattcgcttctcttatattgaagaatcgcaaatcaatgaatggacagagaaaggccaactttatcttttccagttatataacaaggactatgccgaaggtgctcacggacgaaagaaccttcataccctgtattgggaaagtttattctctcctgaaaatctcagcaacattgtgctgaaactgaacgggcaggcagaattgttctatcgtccacaaagtatcaagcaaccattttcacataaaacggggagcaagatgcttaatcgcagggacaagagtggtatgcccatccctgaagcaatctacagaagtctgtaccaatattttaatggcagaaaggctgaaagcgaattgactcttgtcgaaaagtcctatattgaccaagtggttgttaaagatgtgactcatgagatagtaaaggacaggagatacaccaagcctgaatttttcttccacgttcctatcacattcaatgtcaatgcagatggaaacgaatatatcaatgagcaggtgatggaatatctcaaggataatccagacgttaacatcatcggaatagacaggggtgaacgccacctaatatatcttacactaattaaccaacgaggtgagatattgaagcaaaagacattcaatatagttggcaactataactatcatgccaaactggaacagcgcgaacaggagcgtgatcaagctcgtaagagttggcaaagcgttgggaaaatcaaagaactgaaggaaggtttcctttctgctgtcatccatgagatagccatgatgatgataaaatacaatgccattgtagtgcttgaggacttgaatttcggatttaagcgtggacgtttcaaagtggaacgacaagtgtatcagaagtttgagaaaatgctaattgacaaactaaactatctctcctttaaagaccgcaaacctgatgaagcaggaggcatcttacgtggttatcagttgacacagcagtttacgagtttccaaagacttggaaaacaaagtggattccttttctacattcctgctgcctacacctcgaagatagacccagttacaggctttgtcaaccatttcaacttcaatgacatcaccaatgcagaaaaacgaaaggcattcttcatgaagatggaacgaatagagatgcgcaatggcgacatcgagtttgaattcgactatcgcaagtacaagacctatcaaacagactaccaaaacatctggacggttaatagttctggcaaacgcattgtgatgaggattgatgagaatgggcgtaagcaaatgacggattacttcccaactaaagaaatagtgaaagccttttcagataaaaacattacactttgcgagggtacagacttgaaagctttgatggcggtgattgatacaagccccaagaatgcatcattgtatggaacactgttttatgctttccaaaagaccttgcagatgcgtaatagtgattctgcaacagaagaagattacattctttcaccagttactcagaacggaaagcaattcaataccaaagatgaggctgacaaaggacaagattctgctgggaactgggtctcaaagttcccagtagatgcagatgctaacggagcatatcatatagcactaaagggtctcttcttgcttatgaatcaacagacaaagaagatagaaaaccaaaaatggctccagtttatggttcagaagccatataagagctaa

SEQ ID NO: 435 - DNA, 3750 bp, synthetic construct
  source 1..3750: mol_type = other DNA
atgaaagacctaaaacaatttatcggcatatattcagtctcaaagacattgcgctttgagttaagacctattggcaagacacaagaatggatagaaaagaacaagatactggagagtgatgagcagaaagcagaggactaccctaaagtgaagaccctcatagatgactatcataaggtatgtatccgcgaatcgctgagaggtgttcatttagactggagtcctttgaggcaagcattagaagaataccagcaaaccaagagtgacgagagtaaggctgtactggagaaagagcaaacctcgatgcgtaaacagattgctgctgcaatcaaggatttccgccatttcagggaactgactgcgccaacaccacagaagttgattgatgacgtgtttcctggcatctatgaagacgaggcattgaagtctttcaacaggtttgctctgtatttcaggggattccaagataacaggaacaatatctatagtgctgaggccattagtacaggggtgccctataggcttgttcatgacaatttccccaagttcttagcagatatagaagtttatgaaaatatcaaggccacatgcccagaggtcatcgagcaagtggctgtagaaatgcagccattccttgaaggtgtgatgatagatgacatcttcacgctcgacttctacaattcgcttttaactcaagatggtattgatttctttaatcaggtattaggcggcgtagctgaagaagggaagcaaaagtatcgtggcatcaacgaattcgtcaacttgtatcgacagcagcatcctgagttgacaggaaagaaaaaagccttgacgatggtaccactattcaagcaaatactgtcggacagggagacgctttcgtatattccgcagcagatagaatcagaacaacagttgatagatgttttgagtcaattctatgcccacattaccgattatgaatataatggcaagaccatcaacgttctgaaagaactatccaacctgacgaataggattggggactacaatcccgccgggattttcctttctgcaaagacattgactgatgtttctcagaagttgtttggtagatggagtgccatcaacgataaactctacgagaaggctgtcagccagtttggcgaccctgctattgtcaaggacaaaaagaagatagatgcctatcttgcgaaagacgcattcgcgctttcggaaatcaatcttgatagcgaacatcatttgtcgacgtatttctcagaaatggcccttgtcgtagaacaagtaggtagtagttggctacaatttaaggaatggtgcaaaggcagcgacaaacagctgttccttaataacgcagatggaacagaaatcgtcaagaatctgttggacgctatgatggacattctgcacagatgcgctgtgcttgttgtcccaatagagtatgatttggacaaggatttttataatgacttcctgccactctatgctgaactggaaaacgttatctttgtctataacaggacaagaaactatctaaccaagaaaccttctgacaccaagaagttcaaactgaactttggaacgccgacattgggcgatggatggggagtgaacaacgaaagaaagaacaaggctattcttttgtttaaagaaggtctgtcctacttaggcattatgaatgtgaaaggcactctaaagtttgaagagaccaaggatgccagtttgcattcatacaagaagatgacatgtaggtatctgtcaaaaccctttatggacttgcctcacaccttcttttcagagaaaggcattagtactttccacccatcagagcgtatcatggatatctataagaatggtacattcaagaaggattcgccaagctatagtatcgcagcgctgcacgacttaatcgacttctataaagacgctatcaacaaacatgaggattgggttaaatatggcttttcattctcacccacagagtcctacgaagatatcagttcgttctattctgaaatagccaagcaggcatacaaaatcagctttaccaatgtctctgaacaacaagttaatgactgggtagagaacggacagctttatctgttccaattatataataaggattacgccgagggtgctcatgggcgtaagaatctgcatacgctctattgggagaatcttttctctgaagagaatctcaacaaccttgttctcaagttgggagggcaggcagaactcttctatcgccctcaaagcatcaataagccagccaagcacgttgttggcagtaagatgctgaatcgcagggacaagagcggaatgcctattccagaacctatttacagaagtctttaccagtatttcaacggtaagaaacaagaagatgaactgacggcagcggagaaagcatacatcgaccaagttgttgttaaagataccaatcatgagattgtcaaggatagaagatacacaaaaccagaatacttcttccatgttcccattgtattcaatgctaacgctgacggcaacgaatatatcaacgaaagggtgcttgactatctaaaggataatcctgaagtgaacatcatcggcatcgatcgtggtgagcgtcatctgatatatctgacactcatcaaccaacggggtgagattttgaaacagaagaccttcaatatggttggcaactacaactatcatgccaagttggagttgcgcgagaaagaacgtgatgatgccaggaagagttggaagagtgtaggtaaaatcaaggaattgaaagaaggtttcctctcagctgttattcacgaaatagctgtgatgatggttgagaataatgccattgttgtgctcgaagacctaaacttcggcttcaagcgtggtcgttttaaagtggagcgccaagtatatcagaagttcgagaagatgctgattgacaaactgaactacttgtcattcaaagaccgcatggctgatgaagaaggtggcattcttcgaggctaccagctggctctgcaattcacgagtttccaaagacttggaaagcaaagcggtttcttgttctacattcctgctgcctatacgtcgaagattgatcctgtgacgggttttgtcaaccacttcaacctgaacgacatcaccaatgcagaaaagcgtaaggcattcttgatgaatatggagcgtattgaggtgaagaacggcaatgtggagttcgagttcgactatcgtaagttcaagacctaccagacagactatcagaatatatggacggtcaatacctcaggcaagcgcattgtttttgattcagaaacaagaaaggccaaagacgtataccccacgcaagagattattgctgccttcaaggaaaaaggcatcaatctaaatgatggaacggatttgaaacccttaatcgctgatattgaggccaatgcgaagaatgcctcgttctattacgctatatttgatgcattcaagagaacgttgcagatgcgtaacagcaatgcagcgactgaagaagattatattttgtcgcctgttgtttgcaacggcaagcaattctgcaccacggacgaagtcaataagggtaaggatgctgatggaaactggctatccaaactccctgttgatgctgatgccaatggtgcctatcacatcgccctcaaggggctttacctcttaaataaccctcaaacaaagaagatagaaaatgaaaaatggttccaattcatggttgaaaagccctacttagagtaa

SEQ ID NO: 436 - protein, 1291 aa, synthetic construct
MNTMTQRSPVSGGKNPEGQKSVFDSFTHKYALSKTLRFELVPQGKTSESLKAVFEEDKKVEENYQKTKVRLDQLHRLFVQASFTESKVSALKLASFVRAYNALIGVAKKTQTKEQKSAYEKERKALLYEVAGLFDEMGDEWKAQYEEIESVGRTGKQKKIKFSSTGCKILTDEAVLNILMDKFAEDTQVFSTFFGFFTYFGKFNETRENFYKSDGTSTAVATRVVENLEKFLRNKHIVESEYKKVKTAIGLTDSEILALTDVEAYHRCFLQAGIDVYNTVLGGSTELEQSVNKKVNEYRQKTGNKISFLAKLHNQILSEKDVFEMLVIKGDAQLWEKLKVFSEENVAYCTKMLALIRDALTMPEKSGYEWSKIYFSSGAINTISSKYFTNWSVLKGALLDAVGTAKGGGGELPDFVSLQHVQNALDVNEINKGKKPSELFRSEILKHAAFVESVGHFTNLITILLSELDARVAESAVDLADLKKDSFWTTGALSQRRKEKEDEGTIQINRISAYLNSCRDAHRMIKYFATENRRDWVEPEEGYDPKFYDAYREEYAKDIFFPLYNVARNFLTQKPSDENKVKLNFECGTLLSGWDKNKEQEKLGIILRKDGAYYLAIMRKQFSDILEEKKHPEAYRAGDNGYSKMEYKLFPDPKRMIPKVAFAETNKKTFGWTPEVQAIKDEYAKFQESKKEDQSAWKNQFDANKTARLIAYYQNCLAKGGYQETFGLTWKKPEEYVGIGEFNDHIAQQNYKIKFVPVDADYIDEHVAKGEMYLFKIKSKDFASGSTGTKNVHSLYFSQLFSEANLAQTPTVVQLAGNAEIFYREASVEPEKEKRNFPRDITKYKRFTEDKVFFHVPIKINAGTDAMRSQYQFNKILNAELIAKRAKDFCIIGIDRGEKHLAYYSVINQKGVIVDEGSLNEISGTDYHKLLDGKEKERTANRQAWLPVRQIKDLKRGYVSHAVKKICDLAIEHNAIIVLENLNMRFKQIRSGIEKSVYQQLEKQLVDKLGHMVFKDRPELEIGGVLNGYQLAAPFESFKDMGNQTGIVFYTEAAYTSTTDPVTGFRKNVYVSNSATKEKLEKAIKSFDAIGWNEERQSYFITYDPVRLVDKKEKTKTISKLWTVYADVPRIRRERNEQGVWNARNVNPNDMFKSLFEAWNFEDKIATDLKSKIEEKMKNGELSSYKMIDGRERNFFQAFIYIFNIILDIRNSSDKTDFIASPVAPFFTTLNAPKPNPCDINLANGDSLGAYNIARKGIITIGRINDNPEKPDLYISKEQWDEWATKHGIQL

SEQ ID NO: 437 - protein, 1280 aa, synthetic construct
MNKFTNLYSVDITLRNSLIPIGETLENMTQRSYIEHDEQRAEAYKLVKGIIDDYHRAFIDSRLAHFELRVNSRGAFDSIEEFATLYNIRRDKKRDKEFTTVKKNLRKAISQQLTKCDAYGRIDKRELIREDLPYFIDSLDISEDEKEEKKKQVEQFAKFATYFSNFHTNRANMYVADEKSTSIAYRLINQNLPVFLDNMKVFAMLKAIGFEDELDAIYSDMEEKLNVQSLDELFQQDYYSMLLTQRQITVYNEVIGGRSEKDGKKVKGLNEYINSHNQDHPTARLPFLRPLYKQILSDRVSMSWLPEAFVSDEEMIHAINIFHQNIHPLLWGPMDDAGEPLKNILSQIDTFDTEHIFITNDSALTNISQRLFGQYNLITDALLKRLSQQTPRKRGRKPESDEAYEERIRKAFKAIKSFSIAEINESLKSYMEEETYKDVSSYFRAMDERNDEHVQQANIFNRIEHAYTEAKPFLNKQRASNSPYNQDDDAIKCIKALLEAYKTLQRFINPLVGSGEESSKDDMFYGEFMPIVEELKNITPLYNKVRNWLTRKPYSTEKFKICFDNSSFLSGWPQDYETKGGYIAEHNGLYYLFINEVRLNENQIGFLCDHPDEDNASRILLDFQKPDYRNIPRFFIRSKGDNFAPAVEKYGLPIASVIDIYDQGRFETEYRSINSDDYYRSLHKLIDYFKLGFTRHESYKHYTFQWKPTNEYNDISQFYHDVEVSCYQLKRIPINWNHLLELVRQGAVYLFQIYNKDFSTQSKGKGTPNLHTLYWRMLFDERNAQNLVYKLNGQAEIFFRHASIKPENKVVHKANRPIENKNPLRKPVKPNSSFPYEITKDKRYTLDHFEFHVPITMNFKSPGINNVNPIVIDKIRKGEITHVIGIDRGERHLLYLSLIDLKGKIIHQMTLNTISNQWAEGKIDTDYQKLLGQKEGNRLEARRNWKTIENIKELKEGYLSQAIHLIAQLMVENKAIVVLEDLNFGFMRGRQKVEKQVYQQFEKMLITKLNYYVDKKKDADALGGLLHALQLTNKFESFEKLGKQSGFLFYVPAWNTSKIDPVTGFVNLLNLHYETREKASLFFSKFERISFNEEKNWFEFVLDYGKFTTKAEGTRTAWTLCTFGERIETFRDPQANHQWGNRIMNLTQAFKDFFRDSNIDIYGNLKDQICSQQKAKFFEQLLHLMKLLLQMRNSKKDSTSPEDDYILSPVADDNGVFYDSRHSSESLPNDADANGAYNIARKGLWIIRQIQSASADERPSLTLSNKEWLHFAQTKPYLND

SEQ ID NO: 438 - protein, 1249 aa, synthetic construct
LRKILHRHSFIFVAEIIKTHIMENLKKFTNLYSKPITLRFSAEPIGNTGKNFRDNILQKDKDLDESYQEAKLIIDNYHRWHIDTVLKRTNLDENKLLEFYAIYTDKRYKDRDKLLASLQKGFRKVLSDSLLHNEKDLFGEKLITSLIPQWLELCGNKEALEVISKFNKFTTYFTGFNTNRKNIYTEEEKKNSITYRLIHENLLKFIDNINLFERIKETEVANNFDTIKNEAKLNIQLEEVFTITYFNKLLTQSGIDLFNLIIGGYSTEKRVKYKGLNEYINEYNQTHAGNQLPKFRPLFKQILSEKDSTSYIDKQFADSKDVIIAINQSYDAINTYVLPHLTQVLSLITPEKLSLIYIENGADITRISNELCGNYDFIKQHFIKEFELQRPRTSKETIEKYYEKINKAWSKDKFVTLEYINTILRQNNKEDIISYFTKERLATTLKKIEEAYKKFQSILTVDYNGELKSDKESVSLIKDLLDSIKDLQLFIKPLSKGEFETQKDNNFYNEFIPIYSVLNDNISHLYDRVRNYVTQKPYSTEKIKLNFENSTLMSGWDVNKEPDNTTIILRKDGFYYIGIMDKKSNKCFSSKNLPSEGECYEKMEYKLLPGANKMLPKVFFSKSRIEEFAPNPQLLRAYEKGTHKKGVGFRIEDCRNLIDFFKISIEKHNDWKQFNFRFSPTNSYQDISDFYREVEHQGYKITFRNISQSYIDALVAEGKLYLFRLYNKDFSQYSKGQPNLHTMYWKMLFDEDNLANVMYALNGGAELFFRPASLERKITHPANEPIACKSVENKGKASTFKYDLIKDKRYTQDTFQFHVPITLNFKGRGINTPKGFNEHINKYYLPHATHIIGIDRGERNLLYISVIDMNGRIVEQFSLNDIVNEYNGKQYHTDYHHKLDDREKARAKARESWQSIENVKELKEGYLSQVVHKIVQLVLKYNAIIVMEDLEKAFKNNRLKIEKSVYQKFEDALINKLSYIVDKTAGKENVCGLLNALQLAYIPQKKNDIINQCGIIFYIPAWCTSKIDPVTGFINKIDTRYTSIEKAKELIGKFADICYDDENECFEFKIEDYTKLGGIDDTRKDWVLTSRGMRIETVLNPTTQKYSEQVEINLTDEFMKLLQGGIGTNLKDYILHQDNSKFFKDLLRCIKLMLQMRNSKIGTDIDYLISPVKQDNGEFYSSKEEKQKGTDSCGQWKSTLPIDADANGAYNIARKGLMVANKLKSGSIPKEAFAVSNKDWLNFVQQNNV

SEQ ID NO: 439 - protein, 1312 aa, synthetic construct
MFEKLSNIVSISKTIRFKLIPVGKTLENIEKLGKLEKDFERSDFYPILKNISDDYYRQYIKEKLSDLNLDWQKLYDAHELLDSSKKESQKNLEMIQAQYRKVLFNILSGELDKSGEKNSKDLIKNNKALYGKLFKKQFILEVLPDFVNNNDSYSEEDLEGLNLYSKFTTRLKNFWETRKNVFTDKDIVTAIPFRAVNENFGFYYDNIKIFNKNIEYLENKIPNLENELKEADILDDNRSVKDYFTPNGFNYVITQDGIDVYQAIRGGFTKENGEKVQGINEILNLTQQQLRRKPETKNVKLGVLTKLRKQILEYSESTSFLIDQIEDDNDLVDRINKFNVSFFESTEVSPSLFEQIERLYNALKSIKKEEVYIDARNTQKFSQMLFGQWDVIRRGYTVKITEGSKEEKKKYKEYLELDETSKAKRYLNIREIEELVNLVEGFEEVDVFSVLLEKFKMNNIERSEFEAPIYGSPIKLEAIKEYLEKHLEEYHKWKLLLIGNDDLDTDETFYPLLNEVISDYYIIPLYNLTRNYLTRKHSDKDKIKVNFDFPTLADGWSESKISDNRSIILRKDGYYYLGILEDNKLFNNIKSNSLKNYYEIMRYNLFPDAAKMIPKCSISKKEVKNHFENGVDKSIYLDNQFVSPLEISKELYELQNNLVDGKKKYQIDYLRNTDDEVGYKNALVQWITFCKDFLLKYQGTQDFDYSELKEAKYYDKLDQFYADVDSCGYNLDFDNIDEDLVNKAVEDGKLLIFQIYNKDFSPESKGKKNLHTLYWLSMFSEENLRTRKLKLNGQAEIFYRKKLEKKPIIHKEGSILLNKIDKEGNTIPENIYHECYRYLNKKIGREDLSDEAIALFNKDVLKYKEARFDIIKDRRYSESQFFFHVPITFNWDIKTNKNVNQIVQGMIKDGEIKHIIGIDRGERHLLYYSVIDLEGNIVEQGSLNTLEQNRFDNSTVKVDYQNKLRTREEDRDRARKNWTNINKIKELKDGYLSHVVHKLSRLIIKYEAIVIMENLNQGFKRGRFKVERQVYQKFELALMNKLSALSFKEKYDEGKNLEPSGILNPIQACYPVDAYQELQGQNGIVFYLPAAYTSVIDPVTGFTNLFRLKSINSSKYEEFIKKFKNIYFDNEEEDFKFIFNYKDFAKANLVILNNIKSKDWKISTRGERISYNSKKKEYFYVQPTEFLINKLKELNIDYENIDIIPLIDNLEEKAKRKILKALFDTFKYSVQLRNYDFENDYIISPTADDNGNYYNSNEIDIDKTNLPNNGDANGAFNIARKGLLLKDRIVNSNESKVDLKIKNEDWINFIIS

SEQ ID NO: 440 - protein, 1274 aa, synthetic construct
LFNLYSCLTEYILMQITIFTNKNKRNKNNMENSNLFTNKYQVSKTLRFRLEPTGGTDDLLRQAQIIEGDERRNKEAITMKQILDNCHKQIIERVLSDFNFKEHSLEEFFKVYTRNDDDREKDIENLQSKMRKEIADAFTKQDVTKLFSSKFKDFVERGLIKYASNEKERNIVSRFKGFATYFTGFNTNRLNMYSEEAKSTAISFRLINQNLIKFIDNILVYKKVSQTLPSDMLSNIYIDFKAIINTSSLEEFFSINNYNNILTQKQIEIFNAVIGGKKDKDEKIITKGFNQYINEYNQTNKNIRLPKMMRLFNQILSDREGVSARPEPFNNANETISSVRDCFTNEISKQITILSETTSKIESFDIDRIYIKGGEDLRALSNSIYGYFNYIHDRIADKWKHNNPQGKKSPESYQKNLNAYLKGIKSVSLHSIANICGDNKVIEYFRNLGAENTVDFQRENVVSLIDNKYNCASNLLSDAQITDEELRTNSRSIKDLLDAVKSAQRFFRLLCGSGNEPDKDHSFYDEYTPAFEALENSINPLYNKVRSFVTKKDFSTDKFKLNFDSSSFLSGWATKSEYEKSSAFIFIRDNQYYLGINRCLSKEDIAYLEDSTSSSDAKRAVYLFQKVDAKNIPRIFIRSKGSNLAPAVNEFQLPIETILDIYDNKFFTTSYQKKDRTKWKESLTKLIDYYKLGFSQHKSYADFDLKWKASSEYNDINDFLADVQKSCYRIEFININWDKLIEFTEDGKFYLFRIANKDLSGNSTGLPNLHTIYWKMLFDESNLKDIVYKMSGNAEVFMRYNSLKNPIVHKAGVEIKNKCPFTEKKTSIFDYDIIKDRRYTKDQLELHVPILMNFKSPSAAKGNVFNKECLEYIKNNGIKHIIGIDRGERNLLYMVITDLDGNIVEQKSLNQIASNPKLPLFRQDYNKLLKTKADANAQARRDWETINTVKEIKFGFLSQIVHEIAMSIIKYDAIVVLENLNRGFMQKRGLENNVYQKFEQMLLDKLSYYVDKTKHPEEAGGALHAYQLSDTYANFNSLSKNAMVRQSGFVFYIPAWLTSKIDPVTGFASFLKFHRDDSMATIKSTISKFDCFKYDKECDMFHIRIDYNKFSTSCSGGQRKWDLFTFGDRILAERNTMQNSRYVYQTVNLTSEFKNLFATKDIDFSGNLKDSICKIEDVGFFRKLSQLLSLTLQLRNSNAETGEDFLISPVADKDGNFFDSRNCPDSLPKDADANGAYNIARKGLMLVEQLKRCKDVSKFKPAIKNEDWLDYVQR

SEQ ID NO: 441 - protein, 1245 aa, synthetic construct
LQHTKKRIVMANFENFTNLYSISKTLRFELRPDEKTQENIKKHGLLQEDTHRADSYKKVKKIIDEYHKDFIEKSLSSCVLKIESDGKKDSLQEYCELYKKKDKSDSDKKALEKIQEQLRKQIVKSFSDRDEFKKITKKELITDLISGFLDNENKRELVEEFKSFTTYFTGFNENRKNMYSNEEKSTAIAFRLIHENLPKHMDNVSIFERLKTSKVSEDFALLSKELKEELQGKSLEDFFLIESYTKLLSQSQIDNYNALIGGKSLEKNKKIKGLNEYINLYNQKQKESKDRLPKLKMLYKQILSDRGVLSWLPKTFNSDKELLEKIEECRREFTTNEDGKGSLLEKIKQLIISLDKYDSNRIYIRNDKQITNISQKVFGGYGIIYGGLRLLLKKDTPKKKNENNEKYEERLEKRIKALDSVAISTIEEGVDTLELEDRNTILDYFKQNIEILFENIEKNYSIVKDLLNVEYPKERNLRQDKVNIEKIKNYLDSLKSLQNFIKPLCGKGNEAEKDEKFYGEFTLLWDEFNKITQLYNMVRNYITQKPYSEEKIKLNFQNSTLLNGWDLNKERDNTSVLLRKDGLYYLAIMNKDHNKVFDIKQTKEKNSGECYEKIEYKLLPGPNKMLPKVFLSTKGIAEFNPSEELLSNYQKETHKKGDNFKIEDCHALIDFFKTSIEKHKDWKQFGFVFSDTKSYENLSGFYREVEHQGYKITFRNIAVDYIDSLIEEGKIYLFQIYNKDFSPHSKGTPNLHTLYWKMLFEKENLSNVVYKLNGEAEVFFRKKSLSNNKPTHRANEPIDHKNKRNGDYKSMFPYDLIKDKRYTIDKYQFHVPITINFKSENINYINDRVNQYIRKSKDLHIIGIDRGERHLLYISVVDLQGNIKCQKSLNIINNYDYQGKLTEREKERDEERRSWQTIEGIKDLKEGYLSQAIHEISNLILKYNAIVVLEDLNFGFMRGRQKFEHSVYQKFEKMLIDKLNYLADKKKEPEEIGGLLKAYQLTNQFKSFKELGKQSGILFYTQAWNTSKIDPVTGFVNLFDTRYSNTKNAQRFFNNFEDIRFNKDKGYFEFEFDYDKFTTKAEGTKTKWTICTFGNRIETFRNKEKNSQWDSVEIDLTQKFKDLFEEKKIDLENLKAEIVKQDSKEFFEKLLRLFCLTLQLRNSISNTDVDYIISPVANENGVFYNSKECDESLPQDADANGAYNIARKGIMIVERIKANKKGKKLDLAISNKDWLKFAQEKPYRK

SEQ ID NO: 442 - protein, 1188 aa, synthetic construct
MNIYENFTNMYQVNKTIRMGLKPICKTDENIAKFLEEDKERSEKYKIAKKIIDKENRAFIEDRLKDFSISGLDEYLELLKQKKDITKIQKKMRDEISKQLKGFPQFDSKYKFQYITDKEDTEILEYFKKFTTFFTGFNSNRENVYSKEDISTSIGHRIIHENLPKFISNFRILNKAIEALGTGKINEDFKNNEINVTVEELNKIDYFNKVLTQSGIDLYNNLIGILNQNINLYNQQQKVKKNKIGKLETLHKQILSEKDKVSFIEEFAEDNQLLKCIDEYFKEKSCLINVDLKNLLENIDTYSLNGIFIKNDKSLKNISIYLYKDWGYISNLINEEYDYKHKNKVKDDKYYEKRKKAIDKIKYFSIGYIDELLKDKNVPMVECYFKEKINLVVKEFNASLNKFNEYKFTNELKTDEIAVEIIKNLCDSIKKIQGIIKPLIITGNDKDDDFYVEINYIWDELNKFDKIYNMVRNYLTKKDYIEEKIRMMFSKSSFMDGWGKDYGTKEAHIVYHDKNYYLVIVDEKLKLEDIDKLYKPGGDTVHYIYNYQSIDYRNIPRKFIYSKGNRFAPSVERYNLPIEDVIEVYNNKYYRTEYEEKNPKIYKKSLTSLIDYFKIGVNRDMDFEKFDIKLKDSNEYKNINEFYYNLETCCYKLQEEKVNFSVLEEFSYSGKIYLFKIYNKDFSKYSKGTPNLHTLYFKMLFDKENLENPIYKLSGNAEMFFRKGNLDLDKTTIHHANQPINNKNPNNRKRQSVFKYDIIKNRRYTVDKFALHMSITTNFQVYKNKNVNETVNRALKYCDDIYAIGIDRGERNLLYACVVNSRGEIVKQVPLNFVGNTDYHQLLAKREEERMNSRKNWKIIDNIKNLKEGYLSQAIHIITDFMVEYNAVLVLEDLNFRFKEKRMKFEKSVYQKFEKMLIDKLNFLVDKKLDKNANGGLFNAYQLTEKFTSFKDMKNQNGIVFYIPAWMTSKIDPVTGFTNLFYIKYESIEKAKEFFGKFKSIKFNKVDNYFEFEFDYNDFTDRAQGTRSKWTVCSFGPRIEGFRNPEKNNNWDGREIDITEEIKKLLDDYKVSLDEDIKAQIMDINTKDFFEKLIKYFKLVLQMRNSKTGTDIDYIISPVRNKQNEFFDSRKKNEKLPMDADANGAYNIARKGLMFIDIIKETEDKDLKMPKLFIKNKDWLNYVQKSDL

SEQ ID NO: 443 - protein, 1249 aa, synthetic construct; identical to SEQ ID NO: 131

SEQ ID NO: 444 - protein, 1246 aa, synthetic construct
MMETFSDFTNLYPLSKTLRFRLIPVGKTLRHFIDSGILEEDQHRAESYVKVKAIIDDYHRSYIESSLSAFELPVESMGKSNSLEEYYLYHNIRNKTEDIQNALSKVRNNLRKQIVAQLTKNEMFKRIDKKELIQNDLIDFVKNEPDANEKIALISEFRNFTVYFKGFHENRKNMYSDEEKSTSIAFRLIHENLPKFIDNMEVFAKIQNTSISEKFDAIQKELCPDSVAFVDMFKLGYFNRTLSQRQIDAYNTVISGRTTAEGEKIKGLNEYINLYNQQHKQEKLPKMKLLFKQILSDRESASWLPEKLENDKQVVGALVDFWNAIHDTVLAEGGLKTVISSLVSYSLEGIFLKNDLQLTDVSQKATGSWSKIPAAIKQKLEAMNPQKKKESYEGYQERIDKIFKSYKSFSLAFINECLHGEYKIEDYFIKLGAINTDLLQKENHFSHILNTYTDIKEVIESYSESTDTKLIRDNGSIQKIKQFLDAVKDLQSYVKPLLGNGDETGKDERFYGDFVEYWNQLDSITPLYNMVRNYVTQKPYSIEKIKINFQNPTLLNGWDLNKETDNTSVILRRDGKYYLAIMNSKFRKVFLKYPSGSDRNCYEKMEYKLLPGANKMLPKVFFSKSRIQEFMPDERLLSNYEKGTHKKTGNCFSLTDCHALIDFFKKSLNKHEDWKNFGFKFSNTSTYTDMSGFYKEVENQGYKLSFKPVDAVYVDQLVDEGKIFLFQIYNKDFSEHSKGTPNMHTLYWKMLFDETNLGDVVYKLNGEAEVFFRKASIKVSSPTHPANVPIKKKNPKHKDEERLLKYDLIKDKRYTVDQFQFHVPITMNFKSDGNGNINQKVVEYLRSASNIHIIGIDRGERNLLYLVVIDGSGKICEQFSLNEIKVEHNGETYSTNYHDLLDIKENERKQARQSWQSIANIKELKEGYLSQVIHKISELMVKYNAIVVLEDLNTGFMRGRQKVEKQVYQKFEKMLIEKLNYLVFKKQPSDSCGGLMHAYQLTNKFEGFNKLGKQSGFLFYIPAWNTSKMDPMTGFVNLFDLKYESIDKAKSFFSKFDSIRYNVERDMFEWKFNYDEFTKKAEGTKTNWTVCSYGNRIITFRNPNKNSQWDNKEINLTENIKLLFERFGIDLSSNLKDEIMQRTEKEFFIELISLFKLVLQMRNSWTGTDIDYLVSPVCNEKGEFFDSRNVDKALPQNADANGAYNIARKGLILLDRIKESTSDKKLNFSITNKEWLSFVQGCCKNG

SEQ ID NO: 445 - protein, 1302 aa, synthetic construct
MPNISEFSEHFQKTLTLRNELVPVGKTLENIISSNVLINDEKRSEDYKKAKEIIDSYHQEFIEKSLSSVTVDWNDLFSFLSRKEPEDYEEKQKFLEELESIQLEKRKSIVNQFEQYDFGSYTDLKGKKTKELSFESLFKSELFDFLLPNFIKNNEDKKIISSFNKFTSYFTGFYENRKNLYTSAPLPTAVAYRIVNDNFPKFISNQKIFRVWKDNVPKFVEIAKTKLREKGISDLNLEFQFELSNFNSCLNQTGIDSYNELIGQLNFAINLECQQDKNLSELLRKKRSLKMIPLYKQILSDKDSSFCIDEFENDESAINDVISFYKKAVCENGPQRKLSELLRDLSSHDLDKIFIQGKNLNSISKNLFGGKNWSLLRDAIIAEKSKDKSYKKAIKTNPSSDDLDRILSKDEFSISYLSKVCGKDLCEEIDKFIKNQDELLIKINSQAWPSSLKNSDEKNLIKSPLDFLLNFYRFAQAFSSNNTDKDMSLYADYDVSLSLLVSVIGLYNKVRNYATKKPYSLEKIKLNFENPNLATGWSENKENDCLSVILLKNQIYYLGILNKSNKPNFSNGISQQPSSESCYKKMRYLLFKGFNKMLPKCAFTGEVKEHFKESSEDYHLYNKDTFVYPLVINKEIFDLACSTEKVKKFQKAYEKVNYAEYRQSLIKWISFGLEFLSAYKTTSQFDLSNLRKPEEYSDLKEFYEDVDNLTYKIELVDLKEEYVDSLVENGQLFLFEIRNKDFAKKSSGTPNLHTLYFKSIFDPRNLKNCIVKLNGEAEIFYRKKSLKIDDITVHQKGSCLVNKVFFNPDSGKSEQIPDKIYNNIYAYVNGKSTTLSKEDEFFYTKATIKKATHEIVKDKRFTVDKFFFHCPITINYKSKDKPTKFNDRVLDFLRKNEDINIIGIDRGERNLIYATVINQKGEIIDCRSFNTIKHQSSSVNYDVDYHNKLQERENNRKEEKRSWNSISKIADLKEGYLSAVIHEIALMMVKYNAIVVMENLNQGFKRIRGGIAERSVYQKFEKMLIDKLNYFVIKNENWTNPGGVLNGYQLTNKVSTIKEIGNQCGFLFYVPAAYTSKIDPSTGFVNLLNFNKYNNSDKRRELICKFYEICYVQNENLFKFSIDYGKLCPDSKIPVKKWDIFSYGKRIVKEDLKTGYMKENPEYDPTEELKNLFTLMRVEYKKGENILETISIRDMSREFWNSLFKIFKAILQMRNSLTNSPVDRLLSPVKGKDATFFDTDKVDGTKFEKLKDADANGAYNIALKGLLILKNNDSVKTDKELKNVKKVSLEDWLKFVQISLRG

SEQ ID NO: 446 - protein, 1251 aa, synthetic construct
MKRLIDFTNIYQRSKTLRFRLEPIGKTADYIKVSQYLETDERLAKESKKVKELADEYHKEFIGDVLSSLELPLSKINELWDIYMSNDTDREIKFKKLQENLRKVIAEAFSKDKRFGSLFKKEIITDILPKFLQDKDDDIKIVNRFKGFTTYFYAFHKNRENMYVSEEKSTAIPYRIVNQNLVKYFDNYKTFKEKVMPLLKDKNIVESIERDFKDILNEKSIEDVFGLANFTHTLCQADIEKYNTLIGGLVVKNEKKEIKGINQYINEHNQTSKKGNGIPKLKPLFNQILSDRKSLSFTLDDIKKTSEAIRTIKDEYENLRDKLATIERLIKSIKEYDLAGIYIKMGEDTSTISQHWFGAYYKIIEAIADAWERRNPKKNRESKAYSKYLSSLKSISLQEIDDLKIGEPIENYFATFGTTCSDRTSGVSSLNRIEAAYTEFVNKFPEGFEDGDDCNDAYFKANVEVVKNLLDSIKDFQRFVKPLLGNEDERDKDEAFYGEFVPTYTDMDNIITPLYNRVRNFATKKPYSTDKIKINFEKSTLLTGWANYKQYGGVLFCKNDSDFYLGIVKSSKTEIHTVDDSASDIYRIDYALIPNPGKTIPCLMFRDEVKAEKVNGRKDKRTGENLRLEEEKDKYLPAEINRIRKSRSYLKSSECYCNQDMVAYIDYYKKCCISYYDKLSFTFKDSSMYSDWNDFIADVDGQGYQLNRIPVSMQELENLVDNGNMLLFRIANKDFSPNSKGRPNLHTIYWRMLFDPANLKDVVYQLNGNAEIFFRKASITRTEPTHPANVAIKNKSEYNKQNKPYSTFKYGLIKDRRYTTDQFEFHVPITMNFKQPESSKLQDKLNKQVLDFLKQDGVRHIIGIDRGERNLLYLVMVDMEGKIKKQISLNEIAGNPKNSEFKQDFHALLREREGDRLESRRSWNTIQSIKDLKEGYMSLVVHEIANMMLENDAIVVLENLNRSFMQKLGGREKSVYQKFEKMLIDKLGYIVDKTKDVSDNGGALHAVQLADTFENFNKTQKGAIRQCGFIFYIPAWRTSKIDPVTGFVPMLRCQYESIVASKDFFGKFDSIYYDATGKYFVFQTDFTKFNTESKGGIQKWDICTYGDRIYTPRTKDRNNSPVSERVNLTEAMKSLFVLHNINIQGDIKAGIMQQTDKAFFESLHRLLRLTLQIRNSKKSTGENYEDYIISPVMGKDGRFFDSRNADATQPKDADANGAYNIARKGLMLLRQIQAQEKQDLSNGKWLEFAQR

SEQ ID NO: 447 - protein, 1272 aa, synthetic construct
MIIYNCYIGGSFMKKIDSFTNCYSLSKTLRFKLIPIGATQSNFDLNKMLDEDKKRAENYSKAKSIIDKYHRFFIEKALSSVTENKVFDSFLEDIRAYAELYYRSNKDDSDKASMKTLESKMRKFIALALQSDEGFKDLFGQNLIKKTLPEFLESDADKEIIAEFDGFSTYFTGFFNNRKNMYSADDQSTAISHRCINDNLPKFLDNVRTFKNSDVANILNNNLKILNEDFDGIYGTSAEDVFNVDYFPFVLSQKGIEAYNSILGGYTNSDGSKIKGLNEYIYLYNQKNGNIHRIPKMKQLFKQILSERESVSFIPEKFDSDDDVLSSINDYYLERDGGKVLSIEKTVEKIEKLFSAVTDYCTDGIFVKNAAELTAVCSGAFGYWGTVQNAWNNEYDALNGYKETEKYIDKRKKAYKSVESFSLADIQKYADVSESSETNAEVTEWLRNEIKEKCNLAVQGYESSKDLISKPYTESKKLFNNDNAVELIKNALDSVKELENVLRLLLGTGKEESKDENFYGEFLPCYERICEVDSLYDKVRNYMTQKLYKTDKIKINFSNSHFLSGWAQTYSTKGALIVKKENNYYLVIVDKKLSNDDIVFLGTNTQLSPAERIVYDFQKPDNKNTPRLFIRSKGTSYAPAVKEYDLPISDIIEIYDNEYFKTEYRKINPKGYKEALIKLIDYFKLGFSRHESYRCFNFKWKESEQYSDISEFYNDVVKSCYQLKSESINFDSLLKLVDEGKLYLFQLYNKDFSEHSKGTPNLHTLYFKMLFDERNLENVVFKLNGEAEMFYREASISKDDMIVHPKNQPIKNKNEQNSRKQSTFKYDIVKDRRYTVDQFMLHIPITLNFTANGGTNINNEVRKALKDCDKNYVIGIDRGERNLLYICVVDSEGRIIEQYSLNEIINEYNGNTYSTDYHALLDKKEKERLESRKAWKTVENIKELKEGYISQVVHKICELVEKYDAVIVMEDLNFGFKQGRSGKFEKSVYQKFEKMLIDKLNYFADKKKSPEEIGSVLNAYQLTNAFESFEKMGKQNGFIFYVPAYLTSKIDPTTGFADLLHPSSKQSKESMRDFVGRFDSITFNKTENYFEFELDYNKFPRCNTDYRKKWTVCTYGSRIKTFRNPEKNSEWDNKTVELTPAFMALFEKYSIDVNGDIKAQIMSVDKKDFFVELIGLLRLTLQMRNSETGKVDRDYLISPVKNSEGVFYNSDDYKGIENASLPKDADANGAYNIARKGLWIIEQIKACENDAELNKIRLAMSNAEWLEYAQKK

SEQ ID NO: 448 - protein, 1301 aa, synthetic construct
LLPARRCNGAVPHIRHTDNHATPGHSMSLDSFTRKYKLAKTLRFELRPVGRTLETFRSKFLPGDERRAAAYPGAKEMLDNEHKALLERALANPPAGLDWSGLAQAHDTYRTSDKSKAAKGALAARQAVFRKALADHLTKDPSYKTLTAATPKDLFKALKARCEEAGQPVPGDLQTFLRFSCYFKGYQENRRNIYSDKAQATAAANRAVNGNFPRFLEDVRIFRHIAERYPQIPADAARELAPLLEGRTLDSIFTPAAYNGFLAQSRIDFFNSVLGGFVPAEGEKTRGINEFVNLYRQRHEDAREDRALAPLRPLHKQILSDRESHSLVPRMFENDGAVVSAIREMLDKRLLALETENGTENVPDALQSLLATLSPSPAIWIDGAEITRVSKDLLGSWNALSILMEAAAEIRFASESTEKKRDAAVANWMKKPVFSLAEMGGLRVDTDNGANPVDVSGLWKGPVAAARFDAVRKAVAEVRPVLDSAPSGEGTPLRERQEDIARIKAALDAILDLLRFVKPLRAGGELDRDEAFYGAFDPLFDALDGFVPLYNKVRNYLTRKPGETGSVKLMFDNPSFLEGWEQNLETKRTSILFFRDGFYYLGVMAPDAKINFSAFAVSAASGCYRKVVYKAISKAAQYFSIKQIKPQNPPQFVLDWLAKGFDKKTLHRDQLTRLISYVMDDFIPNYPPLKDGSGRVAFDFSFRKPSEYGSWKEFTDHIASMAYKISFEDIPAEAVDRLVEEGKLCLFLLWNKDFSQASNGRPNLHTMYWKAVFSPENLRDVVIKLNGEAEVFYRPKSIRTPFRHKVGEKMVNRRGRDGAPVPEAIHGELFRHANGDTAPLSGAARQWLESGNLVVKEVTHEIVKDARFAADKFSFHVPVTINFKQPDVSARFNDQVRAFLRANPDVKVIGIDRGERNLLYLALVDREGNLLEQRSFNTVSRTRKDGVVTPTDYQAKLVQSEKDRAEARASWAEIGAIKDLKAGYLSAVVHEIAEMMVKHNAIVVLEDLNFGFKRGRFRIERQVYQKFEKALIDKLNYLVFKDRGMEEPGGTLRGYQLTDAFESFEKIGKQTGFLFYVPAGYTSKIDPTTGFTNLFNTKKCTNAAGIRDFFAAFDAIRWDAARRVFAFSFDYRNFKTSQESHRTKWTVYSADRRLAFDKESRSEREINPTAILLGALEERGIAVADGFDLKALLLATEPSKANAAFFRSVFYAFDRTLQMRNSRAEEDYIHSPVLNARGGFFDSREAGDALPREADANGAYHIALKGVQLLEENLAAETPNLKIEHKDWFRFAQELAERKFR

SEQ ID NO: 449 - protein, 1305 aa, synthetic construct
MNKAADNYTGSNYDEFIALSKVQKTLRNELKPTPFTAEHIKQRGIISEDEYRAQQSLELKKIADEYYRNYITHKLNDINNLDFYNLFDAIEEKYKKNDKENRDKLDLVEKSKRGEIAKMLSADDNFKSMFEAKLITKLLPDYVERNYAGEDKEKALETLTLFKGFTTYFKGYFDIRKNMFNGEGGASSICHRIINVNASIFFDNLKTFMRIQEKAGDEIALIEEELTEKLDGWRLEHIFSRDYYNEVLAQKGIDYYNQICGDINKHMNLYCQQNKFKANIFKMMKIQKQIMGISEKAFEIPPMYQNDEEVYASFNEFISRLEEVKLTDRLRNILQNINIYNTAKIYINARYYTNVSSYVYGGWGAIDSAIERYLCNTIAGKGQSKVKKIENAKKDNKFMSVKELDSIVAEYEPDYFNAPYIDDDDNAVKAFGGQGVLGYFNKMSELLADVSLYTIDYNSDDSLIENKESALRIKKQLDDIMSLYHWLQTFIIDEVVEKDNAFYAELEDICCELENVVTLYDRIRNYVTKKPYSTQKFKLNFASPTLAAGWSRSKEFDNNAIILLRNNKYYIAIFNVNNKPDKQIIKGSEEQRLSTDYKKMVYNLLPGPNKMLPKVFIKSDTGKRDYNPSSYILEGYEKNRHIKSSGNFDINYCHDLIDYYKACINKHPEWKNYGFKFKETNQYNDIGQFYKDVEKQGYSISWAYISEEDINKLDEEGKIYLFEIYNKDLSAHSTGRDNLHTMYLKNIFSEDNLKNICIELNGEAELFYRKSSMKSNITHKKDTILVNKTYINETGVRVSLSDEDYMKVYNYYNNNYVIDTENDKNLIDIIEKIGHRKSKIDIVKDKRYTEDKYFLYLPITINYGIEDENVNSKIIEYIAKQDNMNVIGIDRGERNLIYISVIDNKGNIIEQKSFNLVNNYDYKNKLKNMEKTRDNARKNWQEIGKIKDVKSGYLSGVISKIARMVIEYNAIIVMEDLNKGFKRGRFKVERQVYQKFENMLISKLNYLVFKERKADENGGILRGYQLTYIPKSIKNVGKQCGCILYVPAAYTSKIDPATGFINIFDFKKYSGSGINAKVKDKKEFLMSMNSIRYINEGSEEYEKIGHRELFAFSFDYNNFKTYNVSSPVNEWTAYTYGERIKKLYKDGRWLRSEVLNLTENLIKLMEQYNIEYKDGHDIREDISHMDETRNADFICSLFEELKYTVQLRNSKSEAEDENYDRLVSPILNSSNGFYDSSDYMENENNTTHTMPKDADANGAYCIALKGLYEINKIKQNWSDDKKLKESELYIGVTEWLDYIQNRRFE

SEQ ID NO: 450 - protein, 1337 aa, synthetic construct
MTSLYPTSKTIRFKLEPIGKTSENINKNGILSADECKAKDYLKIKETIDAYHKYFIDQQLRLVKTETINKQKTGTKFFLIDGVQNVYNIYNNLKKDRKDEKNRRLFLDKCTALRKKLVSEAFPSEVIKKLTSGKLFTDILPEWVAQENTTRSNEKKLFWSDTFKRFSTYFSGFHENRENMYSGEEKSTAIAYRLINENLPRFFDNVENFGKIQNTLKEWTSIFSDKEKQLFNEKTIKSTFVLENYANCLTQSDITCYNNLICGYTSENKEKVRGLNEFINLHNQKIKDKKEKLRSFKLLYKQILSDRETVSFIPYQFTSINKLYDAINNFYLVCIVNEKDDGGENCNVFEAIEKHFKKIKDGNYDLKHIYISHRSVSSISQKVFGRYSFIKDALEYYYCTDIRPKYEEEIQKAKPSKREKIEKELDNYVNQQYLPIELVDKACEKYSKTLEDNFKHSESSAITDYCAHFLTKIISSKTYSAGKYEDERYSCIKGELNTQHDENYHPSTEVVNNIKLFMDTILESIHRLRDFIIRRDEENICEKDEHFYEFIDKLWEKLSAFINLYDKTRNYLTGKPYSTDKIRLTFNIPALADGWDENKEKDCRAFIFKKSEQYYLGIAAKSGLHFVYNDKEHNLSSCYWKMIYKYFPDPSKMIPKCTITTKDVKTHFASSDDNYELFDPKKFVKPIIISKDIYDIYFNAGPKPAFTGEFIKNGGDQKEYKNALTKWIDFSKQFLSSYSSTAVYNFDSLRPSNSYQNISEFYSEIAALTYKINFKPILSKYIDDLVQKGDLYLFRITTKDFNSTHGMPNLHTLYWRSLFSEENLVKTCIKLNGQANIFYRVPSITSPVIHKKGSILVGRTATNGKNIPEHIYTELCLIKNGKKAEKDADTETREYLTKIKIREAQYDIIKDRRFTQSTFLFHVPLTFNFGIKPSKTFEFNNKINDFLKKHDDVNIIGIDRGERHLLYVSVINRQGDILEQTTLNILNGVDYHSKLDNREKERAGARKNWGTIGRIADLKEGYLSIVIHTLVEMMIRYNAIIVMEDLNTGFKRGRFKVEKQVYQKFEKALITKLNYLCLKDIAIDKIGGILHGWQLTNPFESFKKMGHQNGIIFYIPAWNTSKIDPITGFVNVIKHKYTNRESANKFFENFKEISYKSKDDAFDFVYIDKFSGKNWIITTGGKVRYFWLKDPSGHGGSTQKVDITQKLKNCFTKNNIPWENGENIVETLTTSVNASVLKEVIWCLQRVLAMRNSSAEDGVDFILSPVRMPDGRTFCSNNAGEKLPCDANGAYNIARKGILVMEKIKAGDKNPTLIKNEDWLNYAQSEVVVAMQMKKYK

SEQ ID NO: 451 - protein, 1004 aa, synthetic construct
LSQSEIDSYNSKVGNLNYLVNLYYQQTKNNLPKFKSLFKQIGCGEKKDFLKTIKDNDELNDVLTKAKNLGDKYFTGGKDKETVKAFTDYLLNLDNFENIYWSDKAINTISGKYFGNFGNLKEKLIKAKIFNEDKNSGEAKVPRAVQLSDLFEVLDGQDDWDKEGVLFRENFKDNNKAKQDIIKNAQTPHEALLKMICNDIEDLSKKFIKGADEVLKIEKGDYQKDESKIAIKAWLDDALFAGQILKYWRVKAKYSIDGNFTEILDKVKVFEVVKDYDVVRNYLTQKPQNKLGKLKLNFENSSLAAGWDINKEKDNSCVILQNEHGKQYLAIMKYEETSVFEQNKKNELYMSDNSGWKKINYKLLPGPNKMLPKVLFSSKWVTNNPTPANIKKIYGKGTFKKGDNFNKNDLHILLDFYKNQLKKYPSEKESWDKIFNFDFSNTKSYESVDRFYAEVEKQGYKLEFIPVKKNKIEELVENGKIYLFEIKSKDSNLKNGKEKTSAKDLQTIYWNRIFSDIENKPKLNGEAEIFYRPALEGKNLKRKKWKNKEIIENFRFSKEKFIFHCPITLNPCLKNKRINDLVNQVIVETKNQLFLGIDRGEKNLAYYSLVNQRGEILEQGSFNIINKQNYWEKLDIKQGDRDLARKNWTTIGNIKDLKDGYISQVVRKIVDLAVYNEGDRKKGFRETPALIILEDLNIGFKRGRQKIEKQVYQKLELALAKKLNFLVDKSAKDGEMASVDNALQFTPPVHDFNDIKGKQFGIMFYTNPSFTSATDPITGWHKTISIKKGSEIKEQIFDLFSDFGFDGKDYYFKYKDANIGKEWILYSGKNGAELDRYRDKFSEKEGKKHWSPDRIDIVKNLENIFKGFDKNKSFKEQIKDGKELNKFDKERTAWESLRFVIDVIQQIRNTGEDEKDNDFILSPVRGASGDFFDSRKIKNGAKLPQNGDANGAYNIARKGIIMSEHIKRNADLFVRNEEWDAWLAGEKNWVDYMANNLKIRQKTV

SEQ ID NO: 452 - protein, 1243 aa, synthetic construct
MREKKSSEKLADNFIGVYPVSKTLRFELIPQGKTLEYIQRDGILDSDHHRAENYQKVKELIDRYHKIFIDEALQSIRLENLSEYERLYSAKRDEKQDREFQEIQTSLRKQIAKKFRSHSKYKNLFNKELIKKELILFLKDEPEKRSLVEEFADFTTYFTGFNANRENMYSDEAKGTAIAYRIVHENLPKFIDNMNAFKCLKESGAFLKVKDSLPSLQKKFGLDSVEYFFTIDGFTQVLSQKGIDIYNGVLGGYICEDDTKIQGLNEIINLYNQQQKGEKNRLPKLKVLYKQILSDRESNSFVLDKFENGQEVLEAVKNCYVHFYKYIFEPEEEMSLNNLINDLENFDLGKIYIANDVSITDISQYIYGDWSILRKAISEDYDRHHLSEKMTRDPEKYEDKKQKELKRRELYSIRELNRMAQEYAGTVCNIENYFILQISERLMKINHEYEACRSLLEGESEEKELYKDKNAVLKLKNLLDAMKELQLLIKPLIKGREKAEKDELFYVELVRIWDELNAVNQLYNKVRNYATQKPYSLEKVKLNFNKSTLLDGWDRNKEKDNLGVILIKDNKYYLGIMNRNSNRVMEDAPAAVSTNRYQKMEYKLLPGPNKMLPKVFFSASRIDEFAPDEELLEKYKEGTHKKGDNFSLEDCHRLIDFFKRSLKKHPEWSEFDFSFSDTETYKDISGFYREVERQGYKITFKDIDADYIEKLVEEGQLYLFQIYNKDFSPYSKGTPNLHTIYWKTLFSPDNLKDVVYKLNGQAEIFYRRKSIEEKDIICHPSNEELRNKYPKAEKPTSKFPYELTKDRRFTVDKFQFHVPITMNFKAKGENYFNRKVRRLIHNCQDMHVIGIDRGERNLLYLSVIDMQGKIKEQLPLNDIVSTNKNEVIHHKDYHLLLEKREEENKAARQDWQTINTIKELKEGYLSQAIHIIAELMLKYNAIVVLEDLNFGFMRSRQKFEKQIYQKFERMLIDKLNYLVDKKRDINENGGALRAYQLTDKFESFQKLGKQSGFLFYVPAWNTSKIDPSSGFVNLFYTKYETKEKTRDFIKKFDSIIYNEQENYFEFYFDYSNFTYKAEGSRTKWCLCTEGNRIETFRNPAKNAEWDTKEIILTEGFAGLLEKYHISWKSGEIKKAISEIEEAEFYRSFMHFMSLLLQMRNSDKKAGEDWLMSPVKNSRGEFFKTDKDSEDYPRDADANGAYNIAKKGLWIIEQIQKTEIDQLDKVKIAISNKEWLAYAQEHVL

SEQ ID NO: 453 - protein, 1333 aa, synthetic construct
MKNFQDFTNLYELSKTLRFELKPIGGTKKLIEEKNILKLDKKKRENYEKVKPYFNKIHQEFINFALRNPNFDFSQFEEKYLNWLKDKKNKDLLKEKESIDKIFLEKIGKLFENSVKDFLKENGFESIVKEEDQNLKFFRRKEIFEVLQEKYGSELETQMVNKDGEIKSIFNGWEKWLGYFDKFFNTRDNFYKTDGTSTAIATRIIKDNLKIFLENIVAFGKIKNKKIDFSEVEKNFSVSIDTFFEINNFNNCFLQDGIDFYNKVIGGETLENGEKLKGLNEIINKYRQDTGEKIPYFKKLQKQILSEKDGVFIDKIEDDGGFYEVLKNFYKNAAEKEGFLKNIFENFYTISDKNLEKIYFNKIAFNTISHKFGSALEFERILYEEMKKEKADGIKFEKKENKYKFPDFIQIIFIKRSLENYDSENLFWKERYYKSEENVDGFLEKNNNNLWGQFCKILNFEFLNILKRRIIDEAGEEYEVGFEISKNILGEKLENFELNQENKGIIKDFADYSLALYSFGKYFAVEKGRNWDLNIDISDDFYGGEDGYIEKFYNTGYDEIVKPYNLMRNYISKKPWEDNKKWKINFETSSLLSGWDKNLESNGSYIFQKGNKYYLGIINGSKPAKEILEKLYSGDGEKIKRFIYDFQKPDNKNTPRMFIRSKKDSFSPAVEKYNLPINDILEIYDNGLFKTENKGNPNYKESLRKLIDYFKLGFSRHESFKHFNFVWKDSKSYENIADFYRDVEKSCYKIDFEFLNFEELKKLTFEKHLYLFQIYNKDFELDESLQEKGYNFKGEGQKNIHTKYFEALFLEENISRKSGAVFKLSGGGEVFFRKKSIKAKKEKRNSVEVIKNKRYTECKYFLHFPIQVNFKEEISGNFNQEINKFLANNPDINVIGIDRGEKHLAYFSVINQKGEILESGSFNKIENYNKNGEKLLFPEREIKEIHKDGSLIDLELVETGRKVDYVDYKLLLEYKERKRLLQRQSWKEVEQIKDLKKGYISALVRKIADLIIKHNAIVIFEDLNFRFKQIRGGIEKSIYQQLEKALIDKLNFLVNKNEINLEKAGSILKAYQLTVPVDSLKEIGKQTGVIFYTEAAYTSKIDPITGWRPNLYLKKNNSKINKENILKFDNIVFNSKENRFEFTYDLKKFFGKDSKFPAKTVNTVCSCVERFKWNRNLNNNKGGYIHYENLTDGKLANKEQKEDEFSNFKELFEKYFIDINGNILEQIKNLDTKNNEKFFSSFIDLFTLVCQIRNTNQNAKGDENDFILSPVEPFFDSRKSQNFGKSLPKNGDENGAFNIARKGLIILNRISENPEKPDLLIFNADWDNFARNI

SEQ ID NO: 454 - protein, 1261 aa, synthetic construct
MLFQDFTHLYPLSKTVRFELKPIGKTLEHIHAKNFLSQDKTMADMYQKVKAILDDYHRDFIADMMGEVKLTKLAEFCDVYLKFRKNPKDDGLQKQLKDLQAVLRKEIVKPIGNGGKYKVGYDRLFGAKLFKDGKELGDLAKFVIAQESESSPKLPQIAHFEKFSTYFTGFHDNRKNMYSSDDKHTAIAYRLIHENLPRFIDNLQILATIKQKHSALYDQIASELTASGLDVSLASHLGGYHKLLTQEGITAYNRIIGEVNSYTNKHNQICHKSERIAKLRPLHKQILSDGMGVSFLPSKFADDSEMCQAVNEFYRHYADVFAKVQSLFDRFDDYQKDGIYVEHKNLNELSKRAFGDFGFLKRFLEEYYADVIDPEFNEKFAKTEPDSDEQKKLAGEKDKFVKGVHSLASLEQVIEYYTAGYDDESVQADKLGQYFKHRLAGVDNPIQKIHNSHSTIKGFLERERPAGERALPKIKSDKSPEMTQLRQLKELLDNALNVVHFAKLVSTETVLDTRSDKFYGEFRPLYVELAKITTLYNKVRDYLSQKPFSTEKYKLNFGNPTLLNGWDLNKEKDNFGVILQKDGCYYLALLDKAHKKVFDNAPNTGKSVYQKMVYKQIANARRDLACLLIINGKVVRKTKGLDDLREKYLPYDIYKIYQSESYKVLSPNFNHQDLVKYIDYNKILASGYFEYFDFRFKESSEYKSYKEFLDDVDNCGYKISFCNINADYIDELVEQGQLYLFQIYNKDFSPKAHGKPNLHTLYFKALFSEDNLANPIYKLNGEAQIFYRKASLDMNETTIHRAGEVLENKNPDNPKQRQFVYDIIKDKRYTQDKFMLHVPITMNFGVQGMTIEGFNKKVNQSIQQYDDVNVIGIDRGERHLLYLTVINSKGEILEQRSLNDIITTSANGTQMTTPYHKILNKKKEGRLQARKDWGEIETIKELKAGYLSHVVHQISQLMLKYNAIVVLEDLNFGFKRGRLKVENQVYQNFENALIKKLNHLVLKDKTDDEIGSYKNALQLTNNFTDLKSIGKQTGFLFYVPARNTSKIDPETGFVDLLKPRYENITQSQAFFGKFDKICYNTDKGYFEFHIDYAKFTDEAKNSRQTWVICSHGDKRYVYNKTANQNKGATKGINVNDELKSLFACHHINDKQPNLVMDICQNNDKEFHKSLMYLLKALLALRYSNANSDEDFILSPVANDEGVFFNSALADDTQPQNADANGAYHIALKGLWVLEQIKNSDDLDKVDLEIKDDEWRNFAQNR

SEQ ID NO: 455 - protein, 1238 aa, synthetic construct
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 456 - protein, 1279 aa, synthetic construct
MSNFNEFTHLYQLSKTLRFELKPIGETLKHFNESGILDQDEHRAESYKKVKKLIDRYHKEFMEEALRDFVFQMDDEGKNNSLSEYFFLYSLGKRTEAQDNDFKDVKKNLREQIAKYFKASPKYKNLFKQELIKEDLCNNMQCNEEEQKLVEEFHNFTTYFTGFHENRKNMYSDEEKSTAIAFRLVHQNLPKFIDNIGVFDRVRNIDEIKAGIENLQKHFETEGLFKQGEKIEDFFTLDYYSRLAVQSRIEIYNAILGGKTTEKGEKIQGLNELINLYNQQHKETHLPKMKALFKQILSDRQAVSWIEESFKSDNEVLSSVNDFYENLKQNEIFERTKELLTSVGSYDLSKVYITNDQQLTSISQQLYGSWAVIENAILAEMQNETPRKKKEDAEKYNERLKKAYSNRSSFSIAYIDQCLEAVFGENRIPVEQHFANLGKAEIETEAECGKIKIPDVFTQIEQTYSAAKSLLCNPYPKDKHLSQSDEDIEKVKNLLDALKRFQHFIKPLTGSGDEAEKDEMFYGDLAELWTEIDQLNSLYNKVRNHLTGKPYSEEKLKLNFENATLLNGWDKNKEPDNTAIILRKDGLYYLAIMNKEHNRIFASDKLPNNGECYEKVIYKLLPGANKMLPKVFLSKKGIEVFKPSQEILAIYNNGTHKKGDTFNINDCHKLIDFFKESISKHNDWKNFDFHFSDTNSYEDLSGFYREVENQGYKITFQNISSDYIDNLVNEGKLYLFQIYNKDFSTKRDLSKHKEGTPNMHTLYWQMLFDERNLNDGVYQLNGHAEVFFRKKSLNYTKPTHPANQPIAKKNPHSKNETSQFTYDLIKDKRFTMDKFLFHVPITLNFKSGETDNINAKVRQWLQKADDVHIIGIDRGERHLLYLTVIDSKGNIKEQMSLNTIENKYNGNTYAFDYHNRLDEKEKERDKAKKSWKTVENIKELKEGYLSQAIHKITQLMLKYNAIIVLEDLNIGFMRGRQKVEKQVYQKFEKMLIDKLNYLADKKKDPSEVGGVLNAYQLTSKFESFTKLGRQSGFLFYIPAWNTSKIDPVTGFVNLFDTQYKSDGKAKMFFSKFKSISYNKDKNWFEFSFDYNDFTSKADGTKTEWTVCTNGERIENFRNGETSNQWGGRTINLSQKFKSLFDEYGIDFTKDLQNSICSQSKKGFFKQLLHLFKLTVQMRNSNTETEEEKGKKDFIISPVCVDDKYYNSDIEAEKGKDEEGNWKSELPVNADANGAYNIARKGLMILNHIKQSSDPSKKQEYDLTNKAWLNFVQKGSVEGK

SEQ ID NO: 457 - DNA, 3876 bp, synthetic construct
  source 1..3876: mol_type = other DNA
atgaatactatgacccaacgtagccccgttagcggcggaaaaaaccctgagggccagaagtctgtgtttgactctttcacacataagtacgcgctgtccaagacgctacgcttcgagctcgtgccacagggcaagacgtctgagagtcttaaggccgtgttcgaagaggacaaaaaagttgaagagaactatcagaagaccaaggtacggctcgaccagctgcaccggcttttcgtgcaggcatccttcactgagagcaaggtcagtgcgctgaaactcgcttcttttgtcagagcttacaatgccctgattggcgtcgcaaaaaaaacccagaccaaagaacagaaatcagcttatgagaaagaaagaaaagccctgctctatgaagtggccgggctttttgatgagatgggtgatgagtggaaggctcagtatgaagaaatcgagagcgtcgggcgaacaggaaagcaaaaaaagatcaaattctcctcgaccggttgcaagattctcaccgacgaagccgtcctgaatatcctcatggacaaattcgctgaggacacccaggtattcagcacatttttcgggttcttcacatattttggcaaattcaacgagacacgagaaaatttttacaagagcgacgggacttctactgccgtggcgaccagggttgtagaaaatctcgagaaattccttcgcaacaaacatattgtggagagcgagtataagaaagtaaaaactgccatcggactgactgattccgaaatcctggctttgaccgatgtcgaggcctatcaccgatgctttctgcaggcggggatcgatgtttacaataccgttttaggcggctcaaccgagctggaacaatcagtcaacaaaaaggtgaacgaatacaggcagaagacgggtaataagatcagttttctcgctaaactgcacaaccagattctcagtgaaaaggacgtattcgaaatgctggtgattaaaggtgatgcacagctctgggaaaaacttaaagttttttctgaggagaacgtggcatactgtaccaaaatgcttgccctaatccgcgacgctcttaccatgcctgagaagtcgggatatgagtggtcaaagatctatttttcatcaggggccataaatacgatttcttccaagtacttcacaaactggtccgtgctgaagggcgcactgctggatgctgtaggcacagctaagggcggtggcggagaactgccagacttcgtgtcactgcagcacgttcagaatgcattagacgtcaacgaaatcaataaagggaagaaaccatcagaacttttcagaagtgaaatcttgaagcacgcggcttttgttgaatcggtggggcatttcactaatcttataaccatcttgctgagcgagctggacgctcgtgtggcggaatccgcggtggatttggccgacttaaagaaggacagtttctggactaccggtgcactgtctcagagacggaaagaaaaggaggatgagggaactatccagattaataggatatctgcctacctcaactcttgtcgcgatgcacacaggatgatcaagtactttgcgactgagaataggagagactgggtcgaaccggaggaggggtacgatccaaagttttacgatgcttaccgggaagagtatgccaaggacatattttttcctctttacaacgtcgctcgcaactttttaacgcagaaaccctcagatgagaataaggttaagttgaacttcgaatgcggcaccctcttatctggctgggataagaataaggagcaagaaaagctgggaattatccttcggaaagacggagcgtactatctcgcaattatgagaaaacagttcagtgacattctggaggagaaaaaacatccagaggcctatagagccggcgacaacggttattccaagatggaatataagctgtttcccgatccgaaaaggatgatacctaaggtagcattcgccgagacgaataagaagacttttgggtggacacccgaggtccaggctatcaaagacgagtacgctaagttccaggaaagcaaaaaggaggatcagtccgcctggaaaaatcaattcgatgccaacaagaccgccaggctcatcgcatattaccaaaactgcctggctaaggggggatatcaggagacgtttggtctgacatggaagaagcccgaagagtacgtaggaataggagagtttaatgatcacattgcccaacaaaactacaaaatcaagttcgttccagtggacgccgactacattgatgaacacgtggccaaaggagagatgtacctattcaagattaagagcaaagatttcgcctcaggcagtacagggactaaaaacgtgcacagcctgtatttcagccagttgttttccgaggcaaacctagctcagactcctaccgtcgttcagctggccggtaacgcagaaatcttctatagggaagcctctgtggagcccgaaaaggagaaacgaaactttcctcgcgatatcacaaagtataagagatttacagaggataaggtgttttttcatgtgccgataaaaataaacgccggcaccgatgctatgcgttcccaatatcagttcaacaagatcctgaacgctgaattgattgctaaaagagctaaggatttctgtattattggcattgatcgtggggaaaagcatttggcctactactctgtcatcaatcagaaaggcgtgatcgttgacgagggcagtctcaatgaaattagcgggacagattatcacaagctcctggatggcaaagagaaggagcggaccgccaatcggcaagcttggctgccagtgcgccaaattaaagacctcaagcgcggctatgtcagccatgccgtgaagaaaatatgcgatcttgcaattgagcataacgcgattatcgtgctggaaaacctgaacatgcgctttaaacagataagaagcgggatcgagaagtccgtctatcagcagctggagaagcagttagtcgacaaattagggcacatggtgtttaaggacaggcctgaactggagatcggcggagtcttgaatggctaccagctcgccgccccctttgagtcctttaaggacatgggtaatcagacaggaattgtgttctacaccgaagccgcttacacaagcaccacagaccccgtgactggttttagaaaaaacgtgtatgtgagcaattcagcaactaaagaaaagctagagaaagccataaaatccttcgacgctattgggtggaatgaagagaggcaaagttactttattacctacgaccctgtgagattggtggataagaaggagaagacgaaaacaatttcgaagctatggacagtgtacgccgacgttcctcgaatccggagggagcgaaatgaacagggcgtctggaatgcacggaacgtgaaccccaacgacatgtttaagagcctgttcgaggcctggaatttcgaggacaagattgcaaccgacttgaagagtaagatcgaggagaagatgaagaatggagaattgtcctcatacaagatgattgatgggcgggagcggaatttcttccaagccttcatctacatcttcaacatcatcctagacatcaggaactcctctgacaaaacagatttcattgcaagccctgtagcaccattttttaccaccttaaatgcacccaaacccaatccgtgtgatataaacctggcaaacggagattccctcggtgcctacaatatcgcacgtaaaggaattatcactataggccgcatcaacgacaacccagagaaaccagacctgtatatatctaaagaacagtgggacgaatgggccactaagcacggaatccaactgtga

SEQ ID NO: 458-481 - skipped (24 entries)

SEQ ID NO: 482 - DNA, 3825 bp, synthetic construct
  source 1..3825: mol_type = other DNA
ttgttcaatttatattcttgtttaacagaatatattctgatgcaaataactatatttacaaataaaaacaaacgaaacaaaaataatatggaaaactcaaacctatttacaaacaagtaccaagtaagcaaaaccctccgctttcgccttgagccaaccggaggtactgatgatttacttcgccaagcacaaatcatcgagggagacgagcgccgcaataaagaggctataacaatgaaacagattttggacaattgtcacaaacagataattgagcgcgtattgtccgactttaattttaaagagcattctcttgaagagtttttcaaagtgtataccagaaacgatgatgaccgcgaaaaggacattgaaaatctccaatcaaaaatgcgcaaagaaatagccgacgccttcaccaaacaggatgttacgaaacttttctcaagcaaattcaaggattttgttgaaagaggcttgattaaatatgcatcaaacgagaaggaacgcaacatcgtttcccgcttcaaaggttttgccacttactttacagggttcaacaccaatagactgaatatgtactcagaagaagcaaaatccacagctatatcattcagattaattaatcaaaacttgataaagttcatagacaacatccttgtatataaaaaagtgtctcaaacgttgccttcagatatgctatcaaacatttatatagactttaaggcaatcatcaacacatcaagtcttgaagaattcttctccataaacaactacaataacatactcacccagaaacagattgagattttcaatgcagttataggaggtaaaaaagacaaggatgaaaaaataataaccaaaggattcaaccaatatataaacgaatacaaccagacaaataaaaacatccgtctgcctaagatgatgcggttattcaatcaaatcctaagcgacagagaaggtgtttctgcaagaccagagccattcaataacgcgaacgagacaatcagttccgtccgtgattgttttacaaacgaaatatcaaaacaaataacgatattgtctgaaacaacatccaaaattgaatcattcgacattgatagaatttacattaagggcggagaagatctgagagcattatccaacagtatatatggatatttcaattatatccatgaccgtatcgcagacaaatggaaacacaacaatcctcagggcaaaaagagccccgaaagctaccaaaaaaacctcaacgcatatctgaaaggcataaaaagcgtctctttacacagtattgcaaacatctgtggtgacaacaaagttattgagtatttcaggaatcttggcgcagaaaacactgttgatttccaaagagagaacgttgtatcattaatcgacaacaaatacaactgcgcttcaaatcttttatccgacgcccaaattacggatgaagaacttcgcacaaacagtcgctcaattaaagacttgcttgacgccgtcaagagtgcccaacgatttttccgtctactgtgcggttctggcaacgaaccagacaaagaccactctttttatgacgagtatacaccagcatttgaagcacttgagaattcaataaatcccctatataacaaagtcaggagttttgtaaccaaaaaagatttctccaccgataaattcaaattgaatttcgatagcagcagctttctatccggctgggcaacaaaatcagaatatgagaagagttctgcttttatatttattcgagacaatcaatattacttaggtataaacagatgccttagtaaagaagatattgcttaccttgaggattcaacaagctcatcagatgcaaaaagagcggtatatctgtttcagaaagtggatgccaagaatatccccagaatattcatccgttccaaaggttccaatttagctcctgctgtcaacgaattccaactgccgatagaaaccattcttgacatttatgacaataagtttttcactaccagttatcagaaaaaagaccggactaaatggaaagaatcattgaccaaactcattgactattacaagcttggattcagccagcacaagtcatacgcagatttcgacttaaaatggaaagcatccagtgaatataacgacataaatgactttcttgcagacgtacagaaatcctgctacagaatcgaatttataaacatcaattgggacaagttgatagaattcacagaagatggcaagttttacctattccgcattgcaaataaagacttatcaggcaacagcacaggtctgcccaatttgcacacgatttattggaaaatgctttttgacgaaagtaatctcaaagatattgtctataaaatgtcgggcaatgctgaagtctttatgcgctataattcattaaaaaacccaattgtgcataaagcaggagtagaaatcaaaaacaaatgcccttttactgaaaaaaagacaagcatatttgactacgacattataaaagaccgtcgctatacaaaagatcagcttgaactgcatgttccaatcctaatgaacttcaaaagcccatcggcagcaaaaggaaatgttttcaacaaagaatgcttagaatatataaaaaataatggtataaaacatattataggaatagaccgaggcgaacggaatctactttatatggttataacagaccttgacggcaacatcgttgagcaaaagtctttgaaccaaattgcgagcaatccaaaattgcctcttttcagacaagactacaacaagctgctgaagacaaaggctgatgcaaacgctcaagcacgtcgtgattgggagacaataaacaccgtaaaggagataaaattcggcttcttgagtcagattgtacatgaaatagcaatgtctataataaaatacgatgcaattgttgttttggagaatctgaacagagggtttatgcagaaacgaggtcttgagaacaacgtctatcagaaatttgaacaaatgctacttgacaagttgagctactatgttgacaaaacgaaacatccggaagaggccggaggagctttgcacgcatatcagctctctgacacttacgcgaacttcaattctctgtcgaagaatgcgatggtgcgacagtcaggttttgttttctatattcctgcatggcttacaagcaaaatagaccccgtcacaggattcgcctcctttttgaaatttcacagagatgacagtatggcaacaatcaaatctacaatttcaaagtttgactgtttcaaatacgacaaggaatgcgacatgttccacatccgcattgactataacaagtttagcacaagctgcagcggaggtcaacgcaaatgggacttgttcacttttggcgatcgaatcttggcagaacgcaatacaatgcaaaacagcagatatgtttaccaaacagtcaatttaacttctgaattcaaaaacttatttgccacaaaggatatcgacttttcaggcaacctgaaggactctatatgcaaaattgaggatgttggctttttcagaaaactaagccaactcttgtctctcacgcttcaattacgcaacagcaatgctgaaacaggagaagacttcttgatttccccagtagctgacaaagatggcaatttcttcgattcaagaaactgtcccgactctctcccaaaagacgcagatgccaatggcgcatacaacattgctaggaagggattaatgcttgtcgagcaattgaagagatgcaaagatgtatcaaaattcaagcccgcgataaaaaacgaggactggttagactatgttcaacgctga

SEQ ID NO: 483 - skipped

SEQ ID NO: 484 - DNA, 3567 bp, synthetic construct
  source 1..3567: mol_type = other DNA
atgaacatttacgaaaattttactaatatgtatcaggtgaataagactataagaatggggttaaagccaatatgtaaaactgatgaaaatattgctaaatttcttgaggaagataaggaaagaagtgagaaatacaagatagctaaaaaaataattgataaggaaaatagagcctttatagaggatagattaaaggatttttcaatttcagggttagatgaatatttggaattgcttaaacaaaaaaaggatataacaaaaattcaaaagaaaatgagagatgaaatttcaaaacagttaaaaggcttccctcaatttgatagtaaatataaattccaatatattacagataaagaagatacagaaattttagaatattttaaaaaatttactactttctttacaggatttaattctaatagagaaaatgtttactctaaagaagatatttcgacttctattggacatagaattattcacgaaaatcttccaaaatttatttcaaattttaggattttaaataaagcaatagaggcgttgggaacaggtaaaataaatgaagattttaagaataatgaaattaatgttacagttgaagaacttaataaaatagattattttaacaaggttttaactcaatcaggaatagatttgtataataatttgataggtattttgaatcagaatataaatctatataatcaacaacagaaagtaaaaaagaataaaattggaaagttagaaacattacataaacaaatattaagtgaaaaagataaagtatcgtttattgaagaatttgctgaagataaccagcttttgaaatgtattgatgaatattttaaagaaaaaagttgtttgataaatgtagatttaaagaatttacttgaaaatattgatacttatagtttgaatggtatttttattaaaaatgataagtctttgaaaaatatatctatttatttatataaagattggggatatatatcaaatcttataaatgaagaatacgattataaacacaagaataaggtaaaagatgataagtattatgaaaaaagaaaaaaagctatagataagattaaatatttttctataggatatattgatgaattgttaaaagataaaaatgttcctatggtagaatgctatttcaaagaaaagataaatttagtagtaaaagaatttaatgcttctttaaacaaatttaatgaatataagtttacaaatgagttaaaaactgatgaaattgctgttgaaataataaaaaatttatgtgattcaataaagaagatacagggtataataaagcctttaataattactggaaatgataaagacgatgatttttatgtggaaatcaattatatatgggacgagcttaataagtttgataaaatatataatatggttagaaattatcttacaaaaaaggattacatagaggaaaaaattagaatgatgttttcaaagagtagttttatggatggttggggaaaagattatggaacaaaagaagcacatatagtttatcatgataaaaattattatttagtaatagttgacgaaaaattaaaattagaggatatagataaattatataaaccaggtggagatactgtacattatatatataattatcagtcaatagactatagaaatattcctagaaaattcatatattctaagggtaacagatttgcaccatctgtggaaagatataatttaccaatagaagatgttatcgaagtgtataataataaatattatagaacggagtatgaagagaaaaatcctaaaatttacaaaaaatcattaacatccttaattgattattttaaaataggggtaaatagggatatggattttgaaaaatttgatattaaattaaaagattcaaatgaatacaaaaatataaatgaattttattataatttggaaacttgttgctataagttacaagaagaaaaagttaattttagtgtacttgaagagttttcttatagtggaaaaatttatttatttaaaatatacaataaggatttttctaaatatagcaaaggaacacctaatctccatactttatattttaaaatgctatttgataaagaaaaccttgaaaatcctatttataaacttagtggaaatgctgaaatgttttttagaaaaggaaatcttgatttagataaaacaactatacatcatgctaaccagccaataaataacaaaaatcctaataatagaaagagacaaagtgtatttaaatatgacataattaaaaatagaagatatacagttgataaatttgcattacatatgtcaattactacaaattttcaagtatataagaataaaaatgttaatgaaactgtaaacagagctttaaaatattgtgatgacatttatgctataggtatagatagaggagaaagaaatttattatatgcttgtgtagtaaattcaaggggagaaatagtaaaacaagttcctttaaattttgtaggtaatacagattatcatcaattacttgcaaaaagagaagaagaaagaatgaatagcaggaaaaattggaaaatcattgataatataaagaatttaaaggaaggctatttaagtcaggctatacatataataactgactttatggttgaatataatgctgtacttgttttagaagatttgaattttagatttaaagaaaaaagaatgaaatttgaaaaaagtgtttatcaaaaatttgaaaagatgcttattgataaattgaatttcttagttgataaaaagcttgataagaacgccaatggtggattgtttaatgcgtatcaattaacagaaaaatttacaagctttaaagatatgaaaaatcaaaatggtatagtattttatattcctgcttggatgacaagcaaaattgacccagttacaggatttacaaatttattctatattaaatacgagagtattgaaaaggctaaagagttttttggtaagtttaaatcaataaaatttaataaggtagataactattttgaatttgaatttgattataatgattttactgacagagctcaaggtacaaggtctaaatggacagtttgtagttttggacctagaattgaaggttttagaaatcctgaaaaaaataataattgggatggtagagaaatagatataacagaggaaattaaaaaattacttgatgattataaggtatctttagatgaagatattaaagctcaaattatggatataaataccaaggatttctttgaaaaattgattaaatattttaaacttgtattgcaaatgagaaacagtaaaacaggtacagatattgattatatcatttctccggttagaaataagcaaaatgaattttttgacagtagaaagaaaaatgaaaaattgcctatggatgcagatgcaaatggtgcttataatattgctagaaaaggcttaatgtttattgatataataaaagaaactgaagataaagatttaaagatgcctaaattgttcattaaaaataaggattggttgaattatgtacaaaagagtgatttgtaa

SEQ ID NO: 485 - DNA, 3684 bp, synthetic construct
  source 1..3684: mol_type = other DNA
atgaaagcagaattgtttaagacttttgtggatgagtatcctgtttcaaaaacattaaggtttagtttaatacctgttggaagaaccctagagaatattgagaaagatgggattcttgattgtgatgaaaaaagatctgaagagtataaacgagtaaaaaaactcctcgatgagtattacaagacttttattgagcatgctttgacaaatgtagaacttgatattaatagtcttgaagaatatgagagactttataatataaaaaataaatccgacaaggaaaaggcagattttgatagtgtacagaaaaatctaagaaaacaaatagtcaaagctttaaaagaagatgagaaatataaatttttatttaaaaaagaaattattgaaaaggaattagtggactttttaaatggaagagattcagatgttgaattggttaaatcatttaagggctatgctactatgtttcaaggcttttgggatgcaagaaaaaatatattttctgatgaagaaaagtctacagctattgcatatcgaataattaatgaaaatcttccaaaattcatttcgaataaaaatatatattttactaaaatacaacctgaaatggatgctgaacttgatcaattaacgttatctaataattcaaatgaaattcgtgatatttttaaattggagtatttttctaaaactataactcaaacaggtattgaaatatataatggtattttaggtggatatacaatcgatgaacaggtaaagttgcaaggaatcaatgaaattgtgaatttgcataatcaaaaaaacaaagatagtggaaaaattccaaaacttaaaatgctttataagcagattttatctgatacaaatacgttatcatttatagcagaaggatttgaaacagatgatgaagtgcttgagtctttaaatattttttatgatgttttcaatgaaaatatacttgatgaggatttaggtattattaatttattgagaaatatagataaattttcatatgatggcatttatataaagaatgataaagctttaatagatatttctaattatttatttggagattggcattatattaaaaatgccattaataagaagtatgaaattgataacccaggtaaaaatacagaaaagtatattgtaaagagaaacaagtttataaaaagctttgatagtttttctttgaaatatcttcaagattgtacaggaagtaaatttaatgaacatatattaattaaaataaataatcttattgatgatgtaaaaaaagcgtataattcagttgcactattgattaagaataaatatgaaggtacgaatttaataaacgataaagatgctattgaaaaaataaaacaatttttggattctatgaaaagtttagtttcatttattcgttgttttgaaggtactggtcaagagccagatagagatgagattttctatggtgaatttgatacaggaaagaagacattttattacttaaacaatatatataataaaacgcgtaattatgttacaaaaaaaccttatagcatagaaaaatataaattaaattttgacaatgcagaattattaacaggatgggatttaaataaagagacaagtaaggctagcattattctaaaaaaagataatttgtattatttaggaataatgaaaaagagcgaccgcagagtatttttgaatgtaccagagacagaaagtacatataattgttatgaaaaaatggaatataagttgttaccaggtccaaataaaatgttacctaaagtgttttttgctaaatcaaatatagactattatgaccctagtcctgaaattatgaggatatataaagaaggcacttttaaaaagggtgataatttcaatatagatgattgtcatgatttaatagattactttaaagaatctttggataaaaatgatgattggaaaatttttgattttgacttttcggagacatcatcttataaggatataggggaattttataaagaagtacaacagcaaggatataaaattagttttaagaatatagcatcttcttatgtagatgagcttgttgaaaatggtaagttgtatttgtttcaaatatacaataaagacttttctaaaaatagtaaaggaactgaaaatctacatacaatgtattggagagccttatttgatgaagaaaatttagaaaatgtaatatataaattgaacggtgatgctgagattttctttagacgaaagagtatttcagaaaatgagaaaatagttcatcctgcacatgttgaaattgagaataaaaatgatgagactagaaaagagaaaaaaacaagtattttcaattatgatattataaaagataaacgttttacagttgataaattccagttccatgtacctattacactgaactttcaagcaatagatcgtaaaagtgatattaatttacgtatgagacaagaaattaaaaagaataaggatatgcatataataggaatagatagaggagagcgaaacttattatatataagcataatagatcttgatggaaatattgtaaaacaagaatcacttaatactattaccaatgagtatgatggtaagatttatactactgattatcataaattacttgataaaaaggaagaaaaacgtaaagttgctcgtcaaacatggaatactatagaaaatataaaagaattaaaggctgggtatatgagtcaggtggttcataaaataactcagttaatgatggagtataatgctatagtagtattagaagacttaaacactggatttaaacgaggtcgtcagaaggttgaaaaacaaatttatcaggcttttgaaaaagctttaattaataaattaaactattacgttgataagaaagtagataaaaatgagatatctggtttatataaacctcttcaattaacaaaagaatttgaaagttttaaaaagcttggaaaacagagtggcgctatattttatgttcctgcatggaatacaagtaaaatggatccaacaacaggatttgttaatttattatcagtaaaatatgaaaatatggagaaatcaaaagaatttattaacaaaataaaagatattaattttaaggaagatgattgtggaaaatactatgaatttcatattgatttcaatgagtttaccgataagggcaaagatacaaaaacagattggaatatttgtagttttggcaaacgtatagataatgctcgaaatcaaaaaggggatttcgaaagtaagatgatagacttaacaaatgagtttcataacttattcaaaaagtacggcattaatgataattctaatctgaaggaagatattttaaatgtaaaagaagccaaattttataaagagtttataaatttatttaaattgatgctacagattcgaaatagcgaatcaaatgaaaaagttgattttcttcaatcaccagttaagaataataaaggagagttttttaattcaaataatgtaaatggaaatgaagctccagaaaatgccgatgcaaatggagcatataacattgctagaaaaggattgtggattgttaatcagattaaaacaatgccagatagtcaaatgcataagattaagcttgcaatgaaaaatcaagaatggcttttatttgcacaaaaagggaatgtataa

SEQ ID NO: 486 - skipped

SEQ ID NO: 487 - DNA, 3909 bp, synthetic construct
  source 1..3909: mol_type = other DNA
atgccaaatatttctgaatttagtgaacattttcaaaagactttaacattaagaaacgagttagtacctgtaggaaaaactcttgaaaacatcatttcttctaatgtattgataaatgatgaaaaaagaagtgaagactataaaaaggctaaagagattatagactcttatcatcaagagtttatagaaaaatctctttcatctgtaactgttgattggaatgatttgttctcctttttatccagaaaagaaccagaagactatgaagaaaagcagaagttcctagaagagctagaaagtattcagcttgaaaagagaaaaagcattgttaatcaatttgaacaatatgattttggttcatacacagatttaaagggaaagaaaacaaaggaactaagttttgagagcctttttaaatcggagttatttgattttcttttacctaattttataaaaaataatgaagacaaaaaaataataagtagttttaacaagtttacttcttactttactggtttttacgaaaatagaaagaatttatatacatcagcacctttgccaacggctgttgcttacagaatagttaacgataactttcctaaattcatttctaaccaaaagatctttcgtgtgtggaaagacaatgttcctaagtttgtagaaatagcgaaaactaaactaagagaaaaaggtatttctgatttaaatttagaatttcaatttgagttatcaaatttcaattcatgtttaaatcaaacaggaattgattcttacaatgaactgataggtcaactaaactttgcaattaaccttgaatgtcagcaagacaagaatttaagtgagcttttaaggaagaaaagaagccttaaaatgatacctctgtataaacagattttatcagataaagactcttcattctgcattgacgaatttgaaaatgatgaatcagcgataaatgatgttatttctttttataagaaagcggtttgtgaaaacggtcctcaacgaaaactatccgaattattacgtgatttgtcatctcacgatcttgataagatatttattcaaggtaaaaacttaaattcaatttctaaaaatttatttggaggaaaaaactggtctttactcagagatgccattattgcagaaaagtcaaaagacaaaagctataaaaaggctataaagacaaatccttcatcagacgatcttgacagaattctatctaaagatgaattttcaatttcatacttatcaaaggtatgcggaaaagatttgtgcgaagaaattgataaatttattaaaaatcaagatgaactgttaattaaaataaattcacaagcttggccaagctctcttaagaatagtgacgagaaaaatctcataaaatcaccattagatttcttgttaaatttttatagatttgctcaggcattttcttcaaataatacagataaggatatgtctttatatgccgattatgatgtatctttatctttattggtctctgtaataggtctttataacaaagttagaaactatgcaaccaagaagccttatagtcttgaaaaaatcaaattaaattttgaaaatccaaacttagcaacaggttggagtgaaaacaaagaaaatgattgtttatcagtaatcttattaaaaaatcaaatttactatttaggtattttaaacaaaagtaataaacctaatttttctaatggtatttctcaacaaccttcttcagaaagctgctataaaaagatgagatacttattattcaaaggattcaataaaatgttacctaaatgtgcttttacaggagaagtaaaagagcattttaaggaatcttctgaagattatcatctttataacaaggatacttttgtttatcctcttgttattaacaaagagatttttgatctagcatgcagtacagaaaaagtaaaaaaatttcaaaaagcatatgaaaaggtcaactatgcagaatataggcaatcactgataaagtggatttcttttggccttgaatttttatctgcatacaaaactacatctcaatttgatttatcaaatttaagaaaacctgaagaatatagcgatctaaaagaattttatgaagatgtagacaatctaacatacaagatagaattagtagatttaaaagaagaatatgtagactctttggttgaaaatgggcaactgtttttattcgaaataagaaataaagattttgcaaaaaaatctagtggaactcctaatttacatactctttattttaaaagcatatttgatccgagaaatttaaaaaattgtattgtcaaacttaatggtgaagccgagattttctacagaaagaaaagcttgaagattgatgacataacagttcatcaaaaaggaagttgccttgttaataaagttttcttcaatcctgattctggcaaatccgagcagatcccagacaaaatctataacaatatttatgcatatgttaatggcaaatcaacaactttatcaaaagaagatgagtttttttacacaaaagccacaataaaaaaagcaactcacgagatcgtaaaagataaacgctttactgtggataaattctttttccactgcccaattacgattaactataaatctaaagataagccaactaaatttaatgacagagtattagatttcttaagaaagaatgaagatatcaacattattggaatagatcgaggtgagagaaatcttatctatgcaactgtaattaatcaaaaaggtgaaattattgattgcagatcttttaatacaatcaagcaccagtcttcatctgtaaattatgatgtagattatcacaataaattgcaagaaagagaaaataatagaaaagaagaaaagagatcttggaacagtatttctaaaattgcagaccttaaagaaggatatctttcagctgtaattcatgagatagcattaatgatggttaaatacaatgctattgttgttatggaaaatttgaatcaaggctttaagagaatcagaggcggaatcgctgaaagatctgtgtaccaaaaatttgagaaaatgctgatagataaacttaattattttgttattaaaaatgagaattggacaaatcctggaggagttctcaatggttatcagttgacaaacaaggtatcaacaatcaaagaaattggtaatcaatgtggttttttattctacgtacctgcagcatatacttcaaagatagatccttcaactggttttgttaatttgttgaatttcaataaatacaataactcagataaacgaagagagcttatttgcaaattttacgagatttgttatgtgcaaaatgagaatttatttaaattttctatagattatggaaaattatgccctgatagcaaaatacctgtaaaaaaatgggatattttctcttatgggaaaagaattgttaaggaagatctaaagactggttatatgaaagaaaatccagaatacgatccaactgaagaacttaagaatttgtttacattaatgagggttgagtataaaaaaggtgaaaatatacttgaaacaatatctatcagagacatgagtagagaattttggaattctcttttcaagattttcaaagctatattacaaatgagaaatagtctaactaattcaccggtagacagacttttatctccagtaaagggaaaagatgcaaccttctttgatacagataaagttgatggaactaaatttgaaaaattaaaagatgctgatgcaaatggagcttataacattgcattaaaaggcttattaattctcaaaaataatgattctgtaaagacagacaaagaactaaaaaatgtaaagaaggtaagtcttgaggattggttaaagtttgttcaaatctccttaagaggataa

SEQ ID NO: 488 - DNA, 3756 bp, synthetic construct
  source 1..3756: mol_type = other DNA
atgaaacgcctaattgactttacaaacatctatcagcgatcaaagactttgaggtttcgattggagcctatcggtaaaacggccgactatattaaggtttctcagtacctcgaaactgatgagcgtttggcaaaagagagcaagaaggtaaaagagcttgctgatgaatatcacaaagagtttattggagatgtcctgtcttcgttggaattgcctttaagcaaaatcaacgagttatgggatatatatatgtccaatgatacagaccgcgagataaaattcaaaaaactgcaagagaacctgcgaaaggtgattgcagaggcttttagtaaggacaaacggtttggtagtttattcaaaaaggagataatcacagacattctgccgaaattcttgcaagataaggatgatgatattaagatcgtaaatagattcaagggatttaccacatatttttacgcctttcataaaaatagggaaaatatgtatgtctcggaagagaaatcgactgcaataccatatcgaattgtgaatcaaaatctcgtcaagtattttgacaactacaagacgttcaaagagaaggtaatgcctcttctgaaagacaagaatatagtcgaaagcatagagagagacttcaaagacatcttgaacgaaaaatcaatagaggatgtttttggccttgccaacttcactcatactttatgtcaggctgacatcgagaaatacaatacgttgataggtggccttgtcgtcaaaaacgaaaaaaaagagattaaaggtattaatcagtacattaacgaacataaccaaacgagtaaaaaagggaatggaattccgaaactaaagccgttattcaatcagattttgagcgatagaaaatcgttatcgtttaccttagacgatatcaaaaaaacgtcggaggctattcgcaccattaaggatgagtatgaaaatctccgagacaagttggcgaccatcgaaaggcttattaagtctatcaaggagtatgatcttgcaggtatttacatcaagatgggagaggatacttcgacaatatcgcagcattggtttggtgcgtattataaaatcatcgaagcgatagcagatgcatgggaacgacgaaatccgaagaaaaacagagaatccaaggcatatagcaagtatctatcgtccctaaaaagcatcagtctccaagaaatagatgacctcaaaatcggagagcctatagagaactacttcgcaacttttggcacgacttgttcagaccgaacaagtggagtttcttcgctcaataggatagaagctgcttataccgagttcgtgaacaaatttcctgaaggatttgaagatggcgatgactgtaacgatgcctactttaaggctaatgtggaagtcgtcaaaaatctgctggattcaattaaagattttcagcgttttgtgaagcctttgcttggcaatgaggacgaaagagacaaagacgaggctttctatggagagtttgtcccgacatacacagatatggataacatcataacccctctatacaaccgtgtacgcaattttgccaccaagaaaccatactctacagacaagataaaaatcaactttgaaaaatccacactgcttaccggatgggcaaattacaagcaatatggcggtgtcttgttctgtaaaaatgatagtgatttctatcttggcattgtaaaatcgtccaagacagaaatccatacagtcgatgatagcgcctcggatatatatagaattgattatgctctgattccgaacccgggcaaaaccattccttgtttaatgtttagggatgaggtgaaggctgaaaaggtaaacgggcgtaaagataaacgtacaggtgaaaatttgagattggaagaagaaaaggataagtatcttcctgcagagattaataggatacgtaaatccaggtcttatctgaagagttcggaatgttattgcaaccaagatatggttgcatacatcgactattacaaaaaatgttgtattagttattatgacaaactatcctttactttcaaggatagtagtatgtactcggactggaacgattttatcgctgacgtcgatggtcagggatatcaattgaacaggatacccgtgtctatgcaggagctagagaacttggtagacaatggcaatatgcttctattccgtatcgcgaataaagatttttcgcctaacagcaagggccggcccaatcttcataccatatattggcgaatgcttttcgacccggccaacctgaaagatgttgtatatcagctcaatggtaatgccgaaatattcttccgtaaggcaagcattacgaggacggagcctacacatccggctaacgttgccatcaaaaacaagagcgaatataacaaacagaataagccgtatagtacattcaagtacggtttaatcaaggataggcgctacactaccgaccagttcgagtttcatgtacccatcactatgaacttcaagcaaccagagtcgtctaaactacaggacaagctcaacaagcaagtacttgacttcttgaaacaggacggcgtacgccatattataggcattgatcggggcgaacgtaatctgctatacttggtgatggtagatatggagggcaaaatcaaaaaacaaatatcactcaacgagatagccggtaatccgaagaattccgagttcaaacaagacttccatgcactgctgcgcgagcgcgaaggagaccgtctggagtcccgtcgcagttggaacaccattcagagcattaaggacctcaaagaaggttacatgagcttggtggttcatgaaatagcgaatatgatgcttgagaatgatgctatagtagtgctcgaaaacctgaatcgctcgtttatgcaaaagctcggcggcagagaaaagtctgtataccaaaagttcgaaaagatgcttatcgacaagttgggatacatcgtggataagactaaagatgtgtccgacaacggaggcgcactacatgctgtacagcttgctgatacgtttgaaaacttcaataagacccaaaaaggagctattcgtcaatgtggattcatattctatattcctgcatggcgtaccagcaagattgaccccgttaccggctttgtgccaatgcttaggtgtcaatatgaaagcatcgtagcatccaaagacttctttggaaagttcgacagtatatactacgatgcgacaggaaagtattttgtcttccaaactgactttaccaaattcaataccgagagcaaaggaggaattcaaaaatgggatatatgcacctatggagacagaatatatactcctcgcaccaaagaccggaataatagccctgtttcggaacgtgtaaaccttactgaggcgatgaaatcactgtttgtattgcataatatcaatattcaaggcgatatcaaagccggaattatgcagcagacagacaaggcgttcttcgagtcactgcatcgattgcttcgacttacgttgcaaatacgcaatagcaaaaaatctacaggcgaaaactatgaagactatatcatatcgccggtgatgggcaaggacggtcgtttcttcgattcacgtaacgcggatgctacacaacctaaggatgcagatgccaatggcgcgtacaatattgcgcgcaaaggcttgatgctgcttcgccagattcaagcccaagagaagcaagacctatccaacggaaaatggcttgaatttgcccaaaggtga

SEQ ID NO: 489 - DNA, 3819 bp, synthetic construct
  source 1..3819: mol_type = other DNA
atgataatttataattgttatatcggaggcagttttatgaaaaaaatagatagctttactaactgttattctcttagcaaaaccttgagattcaagctgatacctattggcgctacgcaaagtaattttgatttaaacaaaatgcttgacgaagataaaaaaagggcagaaaactattctaaggcaaaaagcattattgataaatatcatcgcttttttattgagaaagctttatcttcagttaccgagaataaggtttttgacagttttctcgaagatatcagagcatacgctgagctttattacagatcaaataaagatgacagcgacaaggcttcaatgaaaacacttgaaagcaaaatgcgtaagttcattgctttagctttacagtcggatgaaggttttaaagatttgttcggacagaatttaatcaaaaagactcttcccgaatttcttgaaagtgatgcggacaaggagataattgcggaattcgatggtttctcaacatattttaccggtttcttcaataatcgcaaaaacatgtacagcgcagacgatcaatcaacggcaatttcccaccgttgcattaatgataaccttccaaagttccttgacaatgtcagaacatttaaaaattctgatgttgccaacattctcaacaataaccttaaaattctcaatgaagattttgacggtatttacggaacctctgccgaagatgtattcaatgttgattattttccgtttgtgctttcacagaaaggaattgaagcatataattctatactcggtggctatacaaactctgacggcagtaagattaaaggattaaacgaatatatctatctttacaaccaaaagaacgggaacatacatcgtattccaaaaatgaaacagttgtttaaacagattttaagcgaaagggaaagtgtttcattcatacccgaaaaatttgattcggatgatgatgtcctttcttcaattaatgattattatcttgaaagagacggaggaaaagttctttcaattgaaaaaacggttgaaaagattgagaaactattcagcgctgttacggattactgcaccgacggaatatttgttaagaatgccgcagaacttacagctgtctgctcgggagcattcggttattggggcactgttcaaaatgcctggaacaacgagtatgatgctcttaacggttataaagaaaccgaaaaatatatcgataaaagaaaaaaagcgtataaatcggttgaaagcttttctcttgctgatattcaaaagtatgccgatgtttctgaatcttccgaaacaaacgctgaagttacggaatggcttcggaatgaaataaaagaaaaatgcaatttggcggttcagggatatgaatcttccaaggacctgatttcaaaaccttatactgagtcaaaaaaactatttaataatgataatgcggtagaattgattaaaaatgccctcgactccgtgaaggaacttgaaaatgttcttcggctgttgctcggcacaggtaaagaagaatcaaaggatgaaaatttctacggcgaatttcttccttgctatgagcgtatctgtgaagttgattcactttatgacaaggtccgtaattatatgacacagaagctgtataagacggataagattaagattaatttcagcaacagccattttttaagcgggtgggcgcagacttattcaaccaaaggtgctttaattgtaaaaaaagagaataattattatttagtgattgttgataaaaagctttcaaatgatgacatagtgttcctgggtacaaatactcaactaagtcctgcagaaaggattgtatatgattttcaaaagcctgataacaaaaacaccccaaggctgtttattcgttcaaaaggaacaagctatgctccggcagtaaaagagtatgatttgcctatatcggatattattgagatatatgataacgaatactttaaaactgaataccgaaaaattaatcctaagggatataaagaagccctcataaaacttatagattattttaagcttggcttcagcaggcatgaatcatatcgttgttttaatttcaaatggaaagaaagcgaacaatatagcgatatttccgagttctacaatgatgttgtcaaatcctgttatcaattaaagagcgaatcgatcaattttgacagtttattaaaacttgtagatgagggcaaactctatctgtttcagctgtacaacaaggatttttccgaacacagtaagggcactcctaatctccatactctttatttcaaaatgctgtttgatgaaaggaaccttgaaaatgttgtattcaaactcaacggtgaagccgaaatgttctatcgtgaagcaagtatcagtaaggatgatatgattgttcacccaaaaaatcagcccatcaaaaacaagaatgagcaaaacagcagaaagcaaagcacatttaaatatgacattgttaaagacagacgctatactgttgaccagtttatgcttcatataccgataacgctcaattttaccgcaaatggcggcacaaatataaacaatgaagtccgcaaggctctcaaggactgtgataagaactatgttataggtattgaccgtggcgagagaaatcttctttatatctgtgtggttgattcggaaggcagaattattgaacagtattcattaaacgagattatcaatgaatataacggcaatacttattcaaccgactatcacgctcttctcgacaagaaggagaaagagcgtctggaatcccgcaaagcttggaaaaccgttgaaaatattaaggaactgaaagagggatatatcagtcaggttgttcataaaatttgcgagcttgttgaaaaatatgatgctgttatcgttatggaagatttgaactttggctttaaacagggccgtagcggaaagtttgaaaaatccgtttatcagaagtttgaaaaaatgcttattgataagctcaattactttgctgataagaaaaaatctcccgaagaaatcggaagcgttctgaacgcatatcagcttactaatgcttttgaaagctttgagaagatgggaaagcagaatgggtttatcttctatgttcctgcgtatcttacgagtaaaattgacccgacgacaggctttgcggacctgcttcatccgtcgtcaaagcaaagcaaggaatctatgcgtgattttgtaggccgctttgactcaatcacattcaacaaaacagaaaactactttgaatttgaacttgattataacaagttcccgagatgtaatacggattacagaaagaagtggaccgtctgtacttacggcagccgtataaaaaccttcaggaatcctgagaaaaacagtgaatgggacaataaaacggttgaattaacgcctgctttcatggctctttttgaaaaatattcaatagatgttaacggagatattaaggcgcagataatgtccgttgacaaaaaagatttctttgttgagcttattggccttctgaggcttactcttcaaatgagaaacagcgaaacaggcaaggtcgatagagattatcttatatcacccgttaaaaacagcgagggcgtattctataacagcgatgattacaagggtattgaaaacgcttcgttacccaaagacgcagatgcaaacggtgcatacaatattgcaagaaaaggcttgtggattattgagcagattaaagcttgtgaaaatgatgcggagcttaacaaaattcgccttgctatgtctaacgccgaatggcttgaatacgcacagaaaaaatga

SEQ ID NO: 490 - DNA, 3906 bp, synthetic construct
  source 1..3906: mol_type = other DNA
ttgctccctgcccgccggtgcaacggagcggttccgcacatccggcacacggacaaccacgcaacaccaggacattccatgagcctcgattccttcacccgcaaatacaaactcgccaaaaccctccgcttcgagctccgtcccgtggggcggaccctcgaaacgttccgttcgaagttcctgccgggcgacgaacgccgcgccgccgcctatcccggcgcaaaggagatgctggacaacgagcacaaggcgcttctcgaacgggcgctcgccaatccgccggcggggttggattggagcgggctggcacaggcccacgacacctaccgaacaagcgacaagtcgaaagcggcgaaaggcgccttggccgcccggcaggcggtattccggaaggcactggcggaccacctgacgaaagacccgtcatacaaaaccctgacggccgccacgccgaaagaccttttcaaggcgctgaaggcacggtgcgaagaggccggacagccggttcccggcgacttgcagacgttcctgcgcttttcctgctatttcaagggctaccaggaaaaccgccgcaacatctattcggacaaggcgcaggcgacggcggcggcgaaccgggccgtcaacgggaatttcccccgtttcctcgaagacgtccgcatcttccggcacatcgcggaacggtatccgcagattcccgccgatgcggcgcgcgaactcgctccgctgctcgaagggcggacgctcgattccattttcacccccgccgcctacaacggcttcctcgcccagtcgcgcatcgactttttcaattcggttctcggcggattcgttcccgccgaaggcgaaaagacccgcggcatcaacgaattcgtcaacctctaccggcaacggcacgaagacgcccgcgaagaccgcgccctcgccccgctccgccccctccacaagcaaatcctcagcgaccgcgaatcgcattccctcgttccccgcatgttcgaaaacgacggcgccgtcgtgtcggccatccgggagatgctcgacaagcggcttctcgccctggagacggagaacgggaccgaaaacgttcccgacgcgctccaatcccttctggcgacgctttccccgtcgcccgccatctggatcgacggcgcggaaatcacccgcgtttcgaaagacctgctcggttcgtggaacgcgctctccatcctcatggaggccgccgccgaaatccggttcgcttcggaaagcacggagaaaaaacgcgacgccgccgtcgcgaactggatgaaaaagccggtgttttccctcgcggaaatgggcgggctccgcgtggatacggacaacggggcgaaccccgtcgacgtgtcgggactctggaaagggcccgttgcggccgcgcgtttcgacgccgtccgcaaggccgtcgccgaagtgcgcccggtcctcgattccgccccgtccggggaggggacgcccctccgcgaacgccaggaggacatcgcccggatcaaggcggcgctcgacgccatcctcgacctgctccgtttcgtcaaaccgctccgcgcgggcggcgaactcgaccgcgacgaggctttctacggcgcgttcgacccgcttttcgacgccctcgacggcttcgttccgctttacaacaaggtccgcaactacctcacgcggaaaccgggcgaaaccgggagcgtcaagctgatgttcgacaatcctagttttcttgaaggatgggaacagaaccttgagacgaaaagaaccagcatattgtttttccgagatggattctactatctcggcgtaatggctccagacgcaaagattaacttttcggcgtttgccgtttcagcggcttccggttgctaccggaaggtggtttacaaggcaatttcaaaagcggcccaatacttcagcatcaaacaaatcaagccacagaaccctccgcaattcgttttggactggcttgccaaaggttttgacaagaaaaccctgcatcgagatcaactcactcgtttgatttcgtatgtcatggatgatttcataccaaattatcccccattgaaggatggaagcgggcgagtcgcctttgatttttctttccgcaaaccatccgaatacggaagttggaaagaattcacggaccatattgcttccatggcctacaagatttccttcgaggacattcccgcggaagccgtcgaccgcctcgtcgaagaagggaagctgtgcctcttcctcctctggaacaaggatttctcgcaagcgtccaacggccgtccgaacctgcacacgatgtattggaaggcggtgttctccccggaaaacctccgcgacgtcgtcatcaagctcaacggcgaagccgaggtgttctaccgcccgaaaagcatccgcacgcccttccgccacaaggtcggcgagaaaatggtcaaccgccggggccgcgacggcgcgcccgttcccgaagccatccacggcgaactcttccgccacgccaacggggacaccgcgcccctttccggcgccgcgcggcagtggctcgagtccggcaacctcgtggtcaaggaggtgacgcacgaaatcgtcaaggacgcgcgcttcgccgcggacaagttctcgttccacgtcccggtcacgatcaatttcaagcaaccggacgtgtccgcccggttcaacgaccaggtccgcgccttcctccgcgccaacccggacgtgaaggtcatcggcatcgaccgcggcgaacggaacctgctctacctcgcgctcgtggaccgcgagggcaacctgctcgaacagcgttccttcaacaccgtgtcccggacgcgaaaggacggcgtcgtgacgcccaccgactaccaggccaagctcgtccagtccgagaaagaccgcgccgaggcccgcgcttcgtgggcggaaatcggcgccatcaaggacctcaaggcgggatacctttccgccgtcgtccacgaaatcgcggagatgatggtcaagcacaacgccatcgtcgtgctcgaagacctcaacttcgggttcaagcgcggccgtttccgcatcgagcggcaggtctaccagaagttcgagaaggcgctcatcgacaagctcaactaccttgttttcaaggaccgcggcatggaggagccgggggggacgttgcgcggctaccagctcacggatgcattcgagagtttcgagaaaatcgggaagcagaccgggtttctcttctacgtccccgccggctacacctccaaaatcgacccgacgaccggattcacgaacctcttcaacaccaagaagtgcaccaacgccgccggcatccgcgacttcttcgccgcgttcgacgcgatccgttgggatgccgcccgccgtgtcttcgccttctccttcgactacaggaacttcaagacgagccaggaaagccatcggacgaaatggaccgtttattccgcagaccgccgccttgcattcgacaaggagtcccgcagcgagagggaaatcaaccccaccgccatcctcctcggggcgctggaagagaggggcatcgccgtcgcggatggattcgacctcaaggccctgcttctcgccacggaaccctccaaggcaaacgccgccttcttccgctccgtcttttacgccttcgaccggacgctccagatgcggaacagccgcgcggaagaggactacatccactctcctgtcctgaacgcccgcggcgggttcttcgactcccgcgaagcgggcgacgcgctgccccgggaggcggatgccaacggcgcctaccacatcgccctcaaaggcgtccagctcctggaagaaaacctcgccgcggaaacgccaaacctcaagatcgaacacaaggactggttccgcttcgcgcaggaactcgcggagcgcaagttccgttga

SEQ ID NO: 491 - skipped

SEQ ID NO: 492 - DNA, 4014 bp, synthetic construct
  source 1..4014: mol_type = other DNA
atgacatctttatatccaacaagtaaaactatccgttttaagttggaacctattggaaaaacttctgagaatataaacaaaaatggcatactcagcgcagatgaatgcaaagcgaaagactatttaaagataaaagaaacgatagacgcctatcacaaatatttcatagatcaacaacttcgacttgtaaaaacagaaacaataaataagcaaaaaacaggtacaaaattctttctgattgatggcgtacagaatgtctacaacatatacaataatctgaaaaaagacaggaaagatgaaaaaaatcgcaggctttttttagataaatgcactgctctgcgcaaaaaactcgtcagtgaggcttttccatctgaagtaatcaaaaaactgaccagcggaaaactattcactgacattttgccagagtgggtggctcaagagaatactaccagatccaacgaaaaaaaacttttttggtctgatacgtttaagcgattctcaacatattttagtggttttcacgaaaaccgggaaaatatgtattctggcgaagaaaaatctacagccattgcctataggttgattaacgaaaacctccctcgtttttttgataatgtagaaaatttcggaaaaatacaaaatactctgaaagaatggacaagtatttttagcgataaagaaaaacaactttttaatgaaaaaacaattaaatcaacttttgtattagaaaactatgcaaattgccttacgcagagtgatataacatgctataataatttaatttgtgggtatacatctgaaaacaaagaaaaagttcgaggattaaacgagtttatcaatctccacaatcaaaaaattaaggataaaaaagaaaaactccgctcgtttaagttattatataaacaaatactcagcgatcgcgaaacggtttcatttatcccatatcagtttacttcaataaataagttgtatgatgctattaataatttttatttagtttgcatcgtaaatgaaaaagatgatggaggagaaaattgtaatgtttttgaagctattgagaagcattttaaaaaaataaaagatggtaactatgatttaaagcatatttatatatctcatagatctgtttcatctatttcacaaaaagtttttggtaggtattcatttataaaagatgctttagaatattattattgtacagatataagaccaaagtatgaagaagaaatacaaaaagcaaaaccatctaaacgagaaaaaattgaaaaagaactagataattatgtaaatcaacaatatttacctattgagttagttgataaagcttgtgaaaaatattcaaaaacattagaagataattttaaacattctgaatcttcagcaataacagattattgcgctcattttttgaccaaaattatatcctctaaaacttattcagctggaaaatatgaagatgagcgctactcttgcataaagggtgaactgaatacccagcacgatgaaaactaccatccttcaacagaagtggtgaacaatattaaactcttcatggacactatcctagagtctattcacaggctacgggatttcatcattcgacgcgatgaagaaaatatttgtgagaaagatgaacatttttatgaatttattgataaactttgggaaaagttgtcagcgtttataaatctctatgataaaactcgcaactatctaacaggaaaaccatatagcactgataaaattcgccttacattcaacattcctgctcttgccgacggttgggatgaaaacaaagaaaaagattgcagagctttcatttttaaaaaaagcgaacagtattatcttggaattgcagcaaaatctggtttacatttcgtttacaatgataaagaacataatctctcttcatgttactggaaaatgatctacaagtatttccctgatcccagtaaaatgatcccgaaatgcacaattacaacaaaagatgtaaaaactcattttgcatctagtgatgataactatgaactttttgaccctaaaaaatttgtcaaaccaataattatatcgaaagatatatatgatatttacttcaacgcaggtccgaagcctgcctttacgggagaatttattaaaaatggaggcgaccaaaaagagtataaaaatgcattaacaaaatggattgatttttctaaacaatttctttcttcttattcaagtacagctgtttataacttcgatagcttgcgaccgtcaaatagttatcaaaatatcagtgagttttattctgaaatagctgctttaacttataaaataaattttaaacctattctatcaaaatatattgatgatcttgttcaaaaaggtgatttatatctttttagaattactacgaaagattttaattcaactcatggaatgccgaatcttcatactttgtattggagatcccttttttctgaagaaaatctcgttaaaacgtgtataaaattaaatggacaagcaaatattttttatagagttccatcaataactagtccagttattcacaaaaaagggagtattcttgtcggaagaacagcaaccaatggtaaaaacatccctgaacacatttatactgaattatgcttaatcaaaaacggaaaaaaagcagaaaaggatgccgatactgaaacacgtgaataccttacaaaaattaaaatcagggaagctcagtacgatatcatcaaggatcgtcgcttcacacagagtacttttctttttcatgttccactgacttttaattttggaataaagccaagtaaaactttcgaattcaataacaaaataaacgattttttaaagaaacatgatgatgtcaatattatcggtattgatcgtggagaacggcatctcctctatgtatctgtcataaatagacaaggggatattcttgaacagactactctcaacattttaaatggtgttgactatcacagtaaacttgataaccgcgaaaaggagcgcgccggagctcgaaaaaactggggtactatcggtcgaattgccgacttaaaagaagggtatctttccattgtcattcatactttagtcgagatgatgattcgatataatgctataattgtaatggaagatctcaatacgggcttcaagcgtggccgcttcaaagttgaaaaacaggtttatcaaaaatttgaaaaagcattaatcacgaaattaaattatctttgtcttaaagatattgcaatagataaaattggaggcatattgcacggttggcagctcacaaatccatttgaaagctttaaaaaaatgggacatcagaatggtattattttttatattccagcttggaatacaagtaaaattgaccctataactggatttgtaaacgtaataaaacataaatatacaaacagagagtctgcgaataaattttttgaaaactttaaagaaatctcttataaatcaaaagatgatgcttttgatttcgtatatattgataaattttcgggaaaaaactggattatcacaacaggaggaaaggtaaggtacttctggttgaaagatccgtcagggcacggaggttcaacacagaaggttgatattactcaaaaattaaaaaattgtttcactaaaaacaacataccttgggaaaatggtgaaaatatagttgagactcttacaacctcagtcaatgcctcggttctgaaagaagtgatctggtgtctgcagcgtgttctcgccatgcgaaacagttctgcagaagatggtgtggattttattttatcacctgtcaggatgcctgatggtcggacattctgtagtaataacgctggtgaaaaacttccttgcgatgccaatggcgcatataatattgccagaaaaggcatcttggttatggaaaaaataaaagccggcgataaaaatccgactttaattaaaaatgaggattggctcaattatgcacaaagtgaagtcgtcgtcgcaatgcaaatgaaaaaatataagtag

SEQ ID NO: 493 - skipped

SEQ ID NO: 494 - DNA, 3015 bp, synthetic construct
  source 1..3015: mol_type = other DNA
ttgtctcaatcagagattgattcctacaattcaaaagttggcaacctgaattatttggttaatctgtattatcagcaaaccaaaaataaccttcccaaatttaaaagcttattcaagcaaattggttgcggagaaaaaaaagattttttaaaaaccataaaagataacgatgaacttaatgatgttttaacaaaagcaaaaaatcttggcgacaaatattttacgggtggaaaagataaagaaaccgtcaaagcctttacagattatcttttgaatttggataattttgaaaatatctattggtcggacaaggcaattaacacaatctccggaaaatattttggtaatttcggcaatttaaaagaaaaattgataaaagcaaaaattttcaatgaagataaaaacagcggtgaagcaaaagttccgcgggcagtccagctttctgatttgtttgaagttttggacgggcaagatgattgggacaaagaaggcgttttatttcgtgaaaattttaaggataataacaaggcaaagcaagacattattaagaacgcccagacgccgcacgaagcattgttgaaaatgatctgcaatgacattgaggatttatctaaaaaatttattaagggggcggacgaagttctaaaaatcgagaaaggagattatcaaaaagacgaaagcaagattgcgatcaaggcttggcttgacgacgcgctttttgcggggcaaattttgaaatattggagagttaaagcgaaatattctattgatggaaattttacagaaatcctcgataaagttaaggtttttgaagtcgttaaagactatgatgtcgttagaaattatttaactcaaaagccgcaaaacaaactgggaaaattaaaattgaattttgaaaattcatcgctagcggctggctgggatataaataaagaaaaagacaattcttgcgtaatattgcaaaatgaacatggaaaacaatatcttgcgataatgaaatatgaagaaacgagtgtttttgaacaaaacaagaaaaatgaactttatatgtctgataattccgggtggaaaaaaattaattataaacttttacctggaccaaacaagatgttgccaaaagttctattttcttcaaaatgggttactaacaatccaacacctgccaatataaagaaaatttatggcaaaggaacatttaaaaaaggcgataattttaataagaatgatttgcacatattgcttgatttttataaaaatcaactaaaaaaatatccatctgaaaaagaaagctgggataaaatttttaattttgatttttctaatacgaaaagctacgaaagcgttgatcggttctatgcagaggttgaaaaacagggctataaacttgaatttatacctgtaaaaaagaataagattgaagaattggtggaaaacggaaaaatttatctttttgaaattaaaagcaaagatagcaatttgaaaaacggcaaagagaaaacctcggcaaaggacctgcaaacaatttactggaacaggatttttagtgatattgaaaacaaaccaaagttaaatggggaggcggagattttctaccgtccggccttggagggaaaaaatctaaaaaggaaaaagtggaagaataaggaaattattgaaaattttcgttttagtaaggaaaaatttattttccattgcccaattacattgaatccttgcctgaaaaataaaagaattaatgatttagtgaatcaagttattgtagaaaccaaaaaccagctatttctcggaattgacagaggcgaaaaaaaccttgcttactattctcttgtaaatcaaaggggagaaattttagagcagggtagttttaatataataaataagcaaaattattgggaaaagttggacataaaacaaggcgatcgcgacttggcgcgcaaaaattggacgacaatcggcaatataaaagatttaaaagatggatatatttcgcaagttgtaagaaaaattgtcgatttggcggtttacaacgagggcgacaggaaaaaaggttttcgcgaaactcccgcgcttattattcttgaggatttaaatatcggcttcaagcgcgggcggcagaaaattgaaaaacaggtttaccaaaaacttgaacttgccttggctaaaaaattgaattttcttgttgataaaagcgctaaagatggggaaatggcttcggttgataatgccttgcagtttactccgccagttcatgattttaacgatattaaaggcaagcaatttgggattatgttttatactaatccaagctttacctcagccactgatccaattacgggctggcacaaaacaatatctattaaaaaggggtcagaaattaaagagcaaatttttgatttattcagtgattttggttttgatggtaaggattattatttcaaatataaagacgcgaatattggtaaagaatggattttatattccggaaaaaatggtgcggaattggatagatatcgcgataaattttcagaaaaagagggtaagaagcattggagcccggatagaattgatatcgttaaaaatttagaaaatatttttaagggatttgataaaaataaatctttcaaagagcagattaaagatggtaaagaattgaataaattcgacaaagaacgaacagcttgggaaagcttaagatttgttattgatgttattcaacagatccgcaacaccggagaagatgaaaaagacaacgactttattctttctcccgttaggggtgcgagtggtgacttttttgactctcgtaagatcaaaaatggtgcaaaactcccgcaaaatggcgatgctaacggcgcgtataatattgcccgcaagggaattattatgagcgaacatattaaaagaaacgcggatttgtttgtgcgaaatgaagagtgggatgcttggcttgcgggagaaaaaaattgggtagattatatggcgaacaatcttaaaataaggcagaaaactgtttaa

SEQ ID NO: 495 - DNA, 3876 bp, synthetic construct
  source 1..3876: mol_type = other DNA
atgaataccatgacccagagatcgcctgtgtccggtggaaagaatcccgaaggacaaaagtccgtgtttgacagctttactcacaaatacgcattgtcgaagacattgcggtttgagttggtgccgcaaggcaaaacttccgaatccttaaaagctgtttttgaagaagataaaaaagtcgaggaaaactatcaaaagaccaaggtgcgattggaccaattacatcgtttgtttgtgcaagcgtcttttacagaatcaaaagtcagtgcgttaaaacttgcaagttttgtacgtgcatataacgcccttatcggtgttgccaaaaagacacaaacgaaagaacagaagagcgcatatgagaaagaaagaaaagctcttttgtacgaggtcgcaggtctctttgatgagatgggcgatgagtggaaggcacaatatgaagaaatagaatccgttgggcgcacaggcaagcaaaagaaaatcaagttctcatctacaggctgtaaaattctcactgacgaagcggtgttgaatatcctaatggataagtttgctgaagatacacaagtgttttcgacattctttggattcttcacatattttggaaagtttaacgagacgcgagagaatttctacaagagtgacggtacgagcacggcggtggctacacgtgtagtcgaaaatctcgaaaagtttttgcgcaataaacacatcgttgaatccgagtataagaaagtaaaaaccgctatcggactcactgattccgagattcttgcgctgaccgatgttgaggcctatcatcgttgttttttgcaagccggaatcgatgtttacaatactgttcttggaggcagtaccgagcttgagcaaagtgtgaataaaaaagtaaacgaataccgtcagaaaactggaaacaaaatcagttttttggcaaaattacacaatcaaattttgagtgaaaaagacgtgtttgagatgctcgtgataaaaggtgatgcccaactctgggagaaactaaaggtattttctgaagaaaatgtcgcctactgcacgaagatgttggcgctcattcgtgacgcacttactatgccagaaaaaagtgggtatgagtggtcaaaaatatatttctccagtggtgcgatcaatacgatttcgagtaagtacttcacaaactggagtgtactcaagggcgcacttctcgatgcggttggcacggcgaagggtggaggtggggagttacctgattttgtgtcccttcaacacgtacagaatgctctcgatgtgaacgaaataaataaagggaagaaaccgagtgagttgttcaggtcagagatattgaaacatgcagcatttgtcgagagtgtcgggcactttacaaacctcattacaatactcttgagtgaacttgatgcgcgtgttgccgaaagtgcagttgatttggcggacctcaaaaaagattccttttggacaacgggcgcactttcgcagaggcgtaaggaaaaagaagatgaggggacaattcagatcaatcgtatcagcgcgtaccttaatagctgtcgcgatgcgcatcgtatgatcaaatactttgcgacggaaaacaggagagattgggttgagccagaagagggttacgacccaaaattctacgatgcctatcgcgaagaatatgcgaaagacattttctttccgctctacaatgtagcgcgcaattttctcactcaaaaaccatccgatgaaaacaaagtcaaactcaacttcgaatgtggcacccttctttccgggtgggacaaaaacaaagagcaagagaagctgggcattattctgcgaaaagacggcgcttattatcttgcgataatgcgtaaacagtttagtgacatactggaggagaagaaacaccccgaagcgtatcgagcaggtgataatggatattcaaaaatggaatacaaactgtttccagatccaaagcgcatgattcccaaggtggctttcgcggaaaccaacaaaaaaacgtttggatggacaccagaagtgcaggcgattaaagatgagtatgccaagttccaagagtcaaaaaaggaagatcagagtgcgtggaaaaatcagtttgatgcgaataaaactgccagactaattgcgtactatcaaaactgtctcgccaaaggtggttaccaagagacgtttggactcacatggaagaaaccagaggaatatgtgggtatcggtgaatttaatgaccacattgcacagcaaaattacaagataaagtttgttccagtagatgcggactacattgatgagcatgttgcaaaaggagagatgtatttgttcaaaattaaaagcaaagactttgcgagcggatcaacgggtactaaaaatgtgcattcactctacttctcacaactcttttccgaagcaaatctcgcacagacaccgactgtggtacaactcgccggaaatgcggagattttttaccgcgaggcatcggtggagccggaaaaagaaaaacgcaacttcccgcgagacatcaccaaatacaaacgttttaccgaagacaaggtattcttccatgtgccaatcaagatcaacgcggggacggatgcaatgcgtagccaatatcaattcaataagatactcaatgccgagcttatcgcgaagcgcgcaaaagacttttgcatcatcggcattgatcgcggggaaaagcatctcgcatactattcagtgatcaatcaaaaaggtgtgattgtcgacgaagggagtctaaatgagattagcggcaccgactatcacaagcttcttgatggcaaggagaaagaacgtactgccaatcgccaagcatggttaccggtgcgccagatcaaagacctcaagcgtggatatgtatcgcatgctgtcaaaaagatttgcgacctcgccatagaacacaacgcgattatcgtgctcgaaaatctcaacatgcgtttcaaacaaattcgtagtggtattgaaaagagtgtataccaacagctcgaaaagcaactcgtagacaagctcggtcacatggtgttcaaagacaggccggagcttgaaataggcggtgtcctaaacggttatcaactcgccgcgccgtttgagtcgttcaaagacatgggtaatcagaccggtatcgtcttctacactgaagcagcatacacgtcgacgacagatcctgtcaccggattccgtaagaatgtgtatgtcagtaactcagctaccaaagagaagttagaaaaagcaattaaatctttcgatgctattggttggaacgaagaaaggcaaagctactttatcacttacgatccagttagacttgtagataagaaggagaaaactaaaacgatatcgaaattatggacggtatatgcagatgtgccacgtattcgtcgcgagagaaacgaacaaggtgtttggaatgctcggaatgtaaatccgaacgatatgttcaagtctctgtttgaggcgtggaattttgaggacaaaatagcgaccgacctaaaaagtaagatcgaggaaaagatgaaaaatggagaactcagcagctataagatgattgacgggcgagaaaggaacttcttccaggcattcatctatatcttcaatatcattctcgatatccgaaattcgtctgataagaccgacttcattgcatcacccgttgctccattcttcacaaccctcaatgcgccaaagccaaatccatgtgacatcaatctggcgaatggcgactctctcggcgcctacaacattgctcgaaagggtattatcaccattggccgtataaatgataatccagaaaaaccggatttatacatcagtaaagaacagtgggacgaatgggcaactaaacacggaatacaactatga

SEQ ID NO: 496-499 - skipped (4 entries)

SEQ ID NO: 500 - DNA, 36 bp, synthetic construct
  source 1..36: mol_type = other DNA
atctacaacagtagaaattccctataacgatttggc

SEQ ID NO: 501 - DNA, 34 bp, synthetic construct
  source 1..34: mol_type = other DNA
ctacaacagtagaaattccctataacgatttggc

SEQ ID NO: 502 - DNA, 36 bp, synthetic construct
  source 1..36: mol_type = other DNA
ggctataagccctcaataatttctactatcgtagat

SEQ ID NO: 503 - DNA, 36 bp, synthetic construct; identical to SEQ ID NO: 502
  source 1..36: mol_type = other DNA

SEQ ID NO: 504 - DNA, 36 bp, synthetic construct
  source 1..36: mol_type = other DNA
gtctagtaaagacatgtaatttctactattgtagat

SEQ ID NO: 505 - DNA, 36 bp, synthetic construct; identical to SEQ ID NO: 504
  source 1..36: mol_type = other DNA

SEQ ID NO: 506 - DNA, 36 bp, synthetic construct
  source 1..36: mol_type = other DNA
atctacaatagtagaaattaatagtatctcttaaag

SEQ ID NO: 507 - DNA, 36 bp, synthetic construct; identical to SEQ ID NO: 506
  source 1..36: mol_type = other DNA

SEQ ID NO: 508 - DNA, 36 bp, synthetic construct
  source 1..36: mol_type = other DNA
atctacaatagtagaaattaaattagtcttatagac

SEQ ID NO: 509 - DNA, 36 bp, synthetic construct; identical to SEQ ID NO: 508
  source 1..36: mol_type = other DNA

SEQ ID NO: 510 - DNA, 36 bp, synthetic construct
  source 1..36: mol_type = other DNA
atctacaatagtagaaattaaatgtgtcttttagac

SEQ ID NO: 511 - DNA, 36 bp, synthetic construct
  source 1..36: mol_type = other DNA
atctacgatagtagaaattatatattcttattaaac

SEQ ID NO: 512 - DNA, 36 bp, synthetic construct; identical to SEQ ID NO: 211
  source 1..36: mol_type = other DNA

SEQ ID NO: 513 - DNA, 35 bp, synthetic construct; identical to SEQ ID NO: 212
  source 1..35: mol_type = other DNA

SEQ ID NO: 514 - DNA, 36 bp, synthetic construct
  source 1..36: mol_type = other DNA
gtctatatgactaagtaatttctactatgtgtagat

SEQ ID NO: 515 - DNA, 36 bp, synthetic construct; identical to SEQ ID NO: 514
  source 1..36: mol_type = other DNA

SEQ ID NO: 516 - DNA, 36 bp, synthetic construct
  source 1..36: mol_type = other DNA
ggctaaagctctttaagaatttctactgttgtagat

SEQ ID NO: 517 - DNA, 36 bp, synthetic construct; identical to SEQ ID NO: 516
  source 1..36: mol_type = other DNA

SEQ ID NO: 518 - DNA, 36 bp, synthetic construct
  source 1..36: mol_type = other DNA
atctacaatagtagaaattatttgagcctcttaggc

SEQ ID NO: 519 - DNA, 36 bp, synthetic construct; identical to SEQ ID NO: 518
  source 1..36: mol_type = other DNA

SEQ ID NO: 520 - DNA, 36 bp, synthetic construct
  source 1..36: mol_type = other DNA
gaataataatccctttaaatttctactattgtagat

SEQ ID NO: 521 - DNA, 36 bp, synthetic construct; identical to SEQ ID NO: 520
  source 1..36: mol_type = other DNA

SEQ ID NO: 522 - DNA, 36 bp, synthetic construct
  source 1..36: mol_type = other DNA
atctacaacagtagaaattgaggttcgttggtcaac

SEQ ID NO: 523 - DNA, 36 bp, synthetic construct; identical to SEQ ID NO: 522
  source 1..36: mol_type = other DNA

SEQ ID NO: 524 - DNA, 36 bp, synthetic construct
  source 1..36: mol_type = other DNA
atctacacacagtagaaattatttaggttacttaac

SEQ ID NO: 525 - DNA, 36 bp, synthetic construct; identical to SEQ ID NO: 524
  source 1..36: mol_type = other DNA

SEQ ID NO: 526 - DNA, 36 bp, synthetic construct
  source 1..36: mol_type = other DNA
atctacataagtagaaattcttataagttgttagcc

SEQ ID NO: 527 - DNA, 36 bp, synthetic construct; identical to SEQ ID NO: 526
  source 1..36: mol_type = other DNA

SEQ ID NO: 528 - DNA, 36 bp, synthetic construct
  source 1..36: mol_type = other DNA
ctctaataggcatattcaatttctacttttgtagat

SEQ ID NO: 529 - DNA, 35 bp, synthetic construct
  source 1..35: mol_type = other DNA
tctaataggcatattcaatttctacttttgtagat

SEQ ID NO: 530 - DNA, 36 bp, synthetic construct
  source 1..36: mol_type = other DNA
gttttaaggacttagagaatttctactgttgtagat

SEQ ID NO: 531 - DNA, 36 bp, synthetic construct; identical to SEQ ID NO: 530
  source 1..36: mol_type = other DNA

SEQ ID NO: 532 - DNA, 36 bp, synthetic construct
  source 1..36: mol_type = other DNA
atctacaaaagtagaaattagatattatgtttaaac

SEQ ID NO: 533 - DNA, 36 bp, synthetic construct
  source 1..36: mol_type = other DNA
atctacaactagtagaaattttattatttttaatca

SEQ ID NO: 534 - DNA, 36 bp, synthetic construct; identical to SEQ ID NO: 532
  source 1..36: mol_type = other DNA

SEQ ID NO: 535 - DNA, 36 bp, synthetic construct; identical to SEQ ID NO: 533
  source 1..36: mol_type = other DNA

SEQ ID NO: 536 - DNA, 36 bp, synthetic construct
  source 1..36: mol_type = other DNA
gtctaacgaccttttaaatttctactgtttgtagat

SEQ ID NO: 537 - DNA, 36 bp, synthetic construct
  source 1..36: mol_type = other DNA
ctaacgaccttttaaatttctactgtttgtagatat

SEQ ID NO: 538 - DNA, 35 bp, synthetic construct
  source 1..35: mol_type = other DNA
ctcaaaactcattcgaatctctactctttgtagat

SEQ ID NO: 539 - DNA, 34 bp, synthetic construct
  source 1..34: mol_type = other DNA
tcaaaactcattcgaatctctactctttgtagat

SEQ ID NO: 540 - DNA, 36 bp, synthetic construct
  source 1..36: mol_type = other DNA
atctacaatagtagaaattcaatgaggctgttagcc

SEQ ID NO: 541 - DNA, 36 bp, synthetic construct; identical to SEQ ID NO: 540
  source 1..36: mol_type = other DNA

SEQ ID NO: 542 - RNA, 36 nt, synthetic construct
  source 1..36: mol_type = other RNA
gccaaatcgttatagggaatttctactgttgtagat

SEQ ID NO: 543 - RNA, 36 nt, synthetic construct
  source 1..36: mol_type = other RNA
ggctataagccctcaataatttctactatcgtagat

SEQ ID NO: 544 - RNA, 36 nt, synthetic construct
  source 1..36: mol_type = other RNA
gtctagtaaagacatgtaatttctactattgtagat

SEQ ID NO: 545 - RNA, 36 nt, synthetic construct
  source 1..36: mol_type = other RNA
ctttaagagatactattaatttctactattgtagat

SEQ ID NO: 546 - RNA, 36 nt, synthetic construct
  source 1..36: mol_type = other RNA
gtctataagactaatttaatttctactattgtagat

SEQ ID NO: 547 - RNA, 36 nt, synthetic construct
  source 1..36: mol_type = other RNA
gtctaaaagacacatttaatttctactattgtagat

SEQ ID NO: 548 - RNA, 36 nt, synthetic construct
  source 1..36: mol_type = other RNA
gtttaataagaatatataatttctactatcgtagat

SEQ ID NO: 549 - RNA, 36 nt, synthetic construct
  source 1..36: mol_type = other RNA
gcttaatgcttatattaaatttctactattgtagat

SEQ ID NO: 550 - RNA, 36 nt, synthetic construct
  source 1..36: mol_type = other RNA
gtctatatgactaagtaatttctactatgtgtagat

SEQ ID NO: 551 - RNA, 36 nt, synthetic construct
  source 1..36: mol_type = other RNA
ggctaaagctctttaagaatttctactgttgtagat

SEQ ID NO: 552 - RNA, 36 nt, synthetic construct
  source 1..36: mol_type = other RNA
gcctaagaggctcaaataatttctactattgtagat

SEQ ID NO: 553 - RNA, 36 nt, synthetic construct
  source 1..36: mol_type = other RNA
gaataataatccctttaaatttctactattgtagat

SEQ ID NO: 554 - RNA, 36 nt, synthetic construct
  source 1..36: mol_type = other RNA
gttgaccaacgaacctcaatttctactgttgtagat

SEQ ID NO: 555 - RNA, 36 nt, synthetic construct
  source 1..36: mol_type = other RNA
gttaagtaacctaaataatttctactgtgtgtagat

SEQ ID NO: 556 - RNA, 36 nt, synthetic construct
  source 1..36: mol_type = other RNA
ggctaacaacttataagaatttctacttatgtagat

SEQ ID NO: 557 - RNA, 36 nt, synthetic construct
  source 1..36: mol_type = other RNA
ctctaataggcatattcaatttctacttttgtagat

SEQ ID NO: 558 - RNA, 36 nt, synthetic construct
  source 1..36: mol_type = other RNA
gttttaaggacttagagaatttctactgttgtagat

SEQ ID NO: 559 - RNA, 36 nt, synthetic construct
  source 1..36: mol_type = other RNA
gtttaaacataatatctaatttctacttttgtagat

SEQ ID NO: 560 - RNA, 36 nt, synthetic construct
  source 1..36: mol_type = other RNA
tgattaaaaataataaaatttctactagttgtagat

SEQ ID NO: 561 - RNA, 36 nt, synthetic construct
  source 1..36: mol_type = other RNA
gtctaacgaccttttaaatttctactgtttgtagat

SEQ ID NO: 562 - RNA, 35 nt, synthetic construct
  source 1..35: mol_type = other RNA
ctcaaaactcattcgaatctctactctttgtagat

SEQ ID NO: 563 - RNA, 36 nt, synthetic construct
  source 1..36: mol_type = other RNA
ggctaacagcctcattgaatttctactattgtagat

SEQ ID NO: 564 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWDARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDNAELLTGWDLNKETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFQFHVPITLNFQAIDRKSDINLRMRQEIKKNKDMHIIGIDRGERNLLYISIIDLDGNIVKQESLNTITNEYDGKIYTTDYHKLLDKKEEKRKVARQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 565 - DNA, 3684 bp, synthetic construct
  source 1..3684: mol_type = other DNA
atgaaggccgagctgttcaaaaccttcgtggatgaataccctgtgtccaagacactgcggttctctctgatccccgtggggagaaccctggagaatattgagaaggacggcatcctggattgcgacgagaagcggtcagaagagtacaagagagtgaagaagctgctggatgagtattataagaccttcatcgagcacgccctgaccaatgtggagctggacatcaacagcctggaggagtacgagcgcctgtacaacatcaagaataaatccgacaaggagaaggctgacttcgattcagtgcagaagaatctgagaaagcagattgtgaaggcactcaaggaggacgaaaagtataagttcctgtttaagaaggaaatcatcgagaaagagctggttgactttctgaacggccgcgacagcgacgtggaactggtgaaaagcttcaagggctacgctacaatgtttcagggcttttgggacgcacgcaagaatatcttctcagacgaggagaaaagcacagccatcgcctatagaattatcaacgagaatctgcctaagttcatttccaacaaaaatatctactttacaaagatccagccagagatggacgccgaactggatcagctgactctgtcaaataattccaacgaaatcagggatatctttaagctggaatacttcagcaaaaccatcacacagacaggcatcgagatctacaatggcatcctgggcggatataccatcgacgagcaggtgaaactgcagggcattaacgagattgtgaacctgcacaaccagaagaataaggacagcgggaagattccaaagctgaaaatgctgtacaaacagatcctgtctgacactaacactctgagcttcatcgctgaagggttcgagaccgacgacgaagtgctggagagcctgaatatcttttacgacgtgttcaacgagaatatcctggatgaggacctgggcatcatcaatctgctgagaaatatcgataaattctcctatgacggaatctacatcaagaatgacaaggccctgatcgatatctccaattacctgttcggggactggcattacattaaaaacgctatcaataagaagtatgaaatcgataaccctggcaaaaacaccgagaagtatattgtgaagcggaacaagttcattaaatctttcgacagtttctccctgaagtatctgcaggactgcaccggctctaagttcaatgagcacatcctgattaagatcaacaatttaatcgacgacgtgaagaaggcctacaatagcgtggcactgctcatcaagaataagtacgaggggaccaatctcattaacgacaaggacgccatcgagaagatcaagcagttcctggattctatgaagagcctggtgtctttcatcaggtgcttcgaaggtaccggccaagagcccgaccgggacgagatcttttacggggaattcgacaccgggaagaagaccttctactatctgaacaacatctataataagaccagaaattacgtgaccaagaaaccatatagcatcgagaagtacaagctgaatttcgataacgcagagctgctgactgggtgggacctgaataaggagacctctaaggccagtatcatcctgaagaaagacaacctgtactacctgggcatcatgaagaagagcgaccggcgagttttcctgaacgtgcctgagaccgaatccacctacaactgctacgaaaaaatggagtacaagctgctgcccgggccgaacaaaatgctgccaaaggttttcttcgccaaatccaacatcgactactatgatccatcccccgaaattatgcgcatctacaaggagggcacttttaagaagggcgacaattttaacatcgatgattgtcacgacctgattgactacttcaaagagtcactggacaaaaatgatgactggaagattttcgatttcgacttctccgagacctcatcttataaggatattggagagttttacaaggaggtgcagcagcagggatacaaaattagctttaagaatatcgcctcatcatacgtggatgaactggtggagaacggcaagctgtacctgttccagatctacaacaaagattttagcaagaacagcaagggaacagagaacctgcatacaatgtattggcgcgccctgttcgatgaggagaacctggagaacgtcatttacaagctgaacggagatgctgagatcttttttaggcggaagagcatcagcgagaatgagaagatcgtgcacccagcccacgtggagatcgagaacaaaaatgatgaaactaggaaggaaaagaagacctctattttcaactacgacatcattaaagacaagcgcttcacagtggacaaatttcagttccacgtgcctatcactctgaatttccaggccatcgacaggaagtccgatatcaacctgcgcatgagacaggagatcaaaaaaaataaggacatgcatatcatcggtattgaccgcggggagcggaatctgctgtacattagcatcatcgatctggacggaaacatcgtgaagcaggaaagcctgaatacaatcactaatgagtacgacggcaaaatctacaccaccgactatcacaagctgctggataaaaaggaggagaagcggaaagtggccaggcagacatggaacacaatcgagaacatcaaagagctgaaggccggctacatgagccaggtggtgcacaagatcacccagctgatgatggaatacaacgccatcgtggtgctggaggacctgaatactggctttaaaaggggtcgtcagaaggtggaaaaacagatctaccaagccttcgagaaagctctgatcaacaagctgaattattacgtggacaagaaggtggataagaacgagatcagcgggctgtacaagcccctgcagctgaccaaggaatttgagagctttaagaagctgggaaagcagtctggcgcaatcttttatgtgcctgcatggaacaccagcaagatggaccccacaaccggattcgtgaacctgctgtctgtgaagtacgagaacatggagaagtccaaggaattcatcaacaaaatcaaggacattaatttcaaagaagatgactgtggcaaatattacgagtttcatatcgatttcaacgaattcaccgataagggcaaggataccaagactgactggaatatctgttctttcggcaagcgcattgacaatgccaggaatcagaagggggacttcgagagcaagatgatcgatctgacaaatgagttccacaacctgttcaagaagtatggcatcaatgacaactccaacctcaaggaggacattctgaacgtcaaagaggccaaattctacaaggagttcatcaatctgttcaagctgatgctgcagatcaggaacagcgagagtaacgagaaggtggacttcctgcagtcccccgtgaagaataacaagggcgaattcttcaactccaacaacgtgaacggaaatgaggcccctgagaacgccgacgccaatggggcctacaacattgcccggaaaggcctgtggattgttaaccagatcaagactatgccggactcacagatgcacaagatcaagctggctatgaagaatcaggaatggctgctgttcgcccagaaagggaacgtgtga

SEQ ID NO: 566 - DNA, 3879 bp, synthetic construct
  source 1..3879: mol_type = other DNA
atggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctcgagtgcttcaacaggttcagcacctactttaccggcttccacagaaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagctgaacttcgactgtcctaccctggccaacggctgggatgagaatcaggagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaacctcgaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctgttttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacatacctgttccactgtcctatcaccatgaactttaaggccaaggacagaacaaataaagaattcaacaaccacgtgctggaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggaggggtcccgtgacgccgcccgcaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctgttcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggac

SEQ ID NO: 567 - DNA, 3879 bp, synthetic construct
  source 1..3879: mol_type = other DNA
atggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctcgagtgcttcaacaggttcagcacctactttaccggcttccacagaaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagctgaacttcgactgtcctaccctggccaacggctgggatgagaatcaggagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaacctcgaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctgttttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacatacctgttccactgtcctatcaccatgaactttaaggccaaggacagaacaaataaagaattcaacaaccacgtgctggaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggagggatccaaagacgccgccgccaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctgttcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggac

SEQ ID NO: 568 - DNA, 3879 bp, synthetic construct
  source 1..3879: mol_type = other DNA
atggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctcgagtgcttcaacaggttcagcacctactttaccggcttccacagaaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagctgaacttcgactgtcctaccctggccagaggctgggatgagaatagagagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaatctagaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctgttttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacatacctgttccactgtcctatcaccatgaactttaaggccaaggacagaacaaataaagaattcaacaaccacgtgctggaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggaggggtcccgtgacgccgcccgcaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctgttcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggac

SEQ ID NO: 569 - DNA, 3879 bp, synthetic construct
  source 1..3879: mol_type = other DNA
atggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctggagtgcttcaacaggttcagcacctactttaccggcttccacgacaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagcttaacttcgacagacctaccctggccaacggctgggatgagaatcaggagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaacctcgaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctgttttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacatacctgttccactgtcctatcaccatgaactttaaggccaaggacagaacaaataaagaattcaacaaccacgtgctggaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggaggggtcccgtgacgccgcccgcaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctgttcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggac

SEQ ID NO: 570 - DNA, 3879 bp, synthetic construct
  source 1..3879: mol_type = other DNA
atggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctggagtgcttcaacaggttcagcacctactttaccggcttccacgacaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagcttaacttcgacaaccctaccctggccaacggctgggatgagaatcaggagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaacctcgaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctgttttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacatacctgttccactgtcctatcaccatgaactttaaggccaaggacagaacaaataaagaattcaacaaccacgtgctggaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggaggggtcccgtgacgccgcccgcaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctgttcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggac

SEQ ID NO: 571 - DNA, 3879 bp, synthetic construct
  source 1..3879: mol_type = other DNA
atggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctggagtgcttcaacaggttcagcacctactttaccggcttccacgacaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagctgaacttcgactgtcctaccctggccaacggctgggatgagaatcaggagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaacctcgaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctgttttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacataccagttccactgtcctatcaccatgaactttaaggccaaggacagaacaaataaagaattcaacaaccacgttctagaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggaggggtcccgtgacgccgcccgcaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctgttcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggac

SEQ ID NO: 572 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacagaaacagaaagaatatgtactctagcgagaagaagtccacagccatcgcctatagatgcgtgaacgataatctgcctagatttctagacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagctgaacttcgacaacccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcagcctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagctgctggacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 573 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacagaaacagaaagaatatgtactctagcgagaagaagtccacagccatcgcctatagatgcgtgaacgataatctgcctagatttctagacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagctgaacttcgacaacccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcagcctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagctgctggacaagaaagagaaggaaaaggataaggcggccaagaattggacctccgtcgagaacatcaaggaactgaaggagggctacatcagccaggtggtgcacaagatatgtgaactagtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 574 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacagaaacagaaagaatatgtactctagcgagaagaagtccacagccatcgcctatagatgcgtgaacgataatctgcctagatttctagacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagctgaacttcgacaacccccagttgctgagaggatgggataaaaacagagaaagcgactacagaaccgtgatcctgaggaagaacgacttttattacctggctgtgatggacaaaagccacagcaaggtgttcgtgaacgcccctgagatcactagtgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcagcctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagctgctggacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 575 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacaccaacagaaagaatatgtactctagcgagaagaagtccacagccatcgcctatagatgcgtgaacgataatctgcctagatttctggacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagcttaacttcgacagaccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcctgctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagcttctagacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 576 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacaccaacagaaagaatatgtactctagcgagaagaagtccacagccatcgcctatagatgcgtgaacgataatctgcctagatttctggacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagcttaacttcgacagaccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcagcctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagctgctggacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 577 - DNA, 3681 bp, synthetic construct
  source 1..3681: mol_type = other DNA
atgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacaccaacagaaagaatatgtactctagcgagaagaagtccacagccatcgcctatagatgcgtgaacgataatctgcctagatttctggacaatatcaagacattccagaagatcttcgacaacctgtccgatgagacaatcacaaagctgaatacagatctgtacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagctgaacttcgacaacccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcctgctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagcttctagacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagaga

SEQ ID NO: 578 - DNA, 3681 bp, synthetic construct
  source 1..3681: mol_type = other DNA
atgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctggagagctcgaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacaatgccgaactgctgaccggatgggatctgaacaaggagacatctaaggcctccatcattctgaagaaggacaatctgtactatctcggaatcatgaagaagtctgatagacgggtgttcctgaacgtgccagaaaccgagagcacctacaactgctacgagaagatggagtacaaactgctccccggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagacaagcatctttaactacgacatcatcaaggataagagattcaccgtggacaaatttcagtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagcgcaaagtcgccagacagacctggaacaccatcgagaatatcaaggaactgaaagctggatacatgagccaggtggtgcataaaattacacagctgatgatggaatacaacgcaatcgtcgtgctggaagatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtg

SEQ ID NO: 579 - DNA, 3681 bp, synthetic construct
  source 1..3681: mol_type = other DNA
atgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctggagagctcgaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacaatgccgaactgctgaccggatgggatctgaacaaggagacatctaaggcctccatcattctgaagaaggacaatctgtactatctcggaatcatgaagaagtctgatagacgggtgttcctgaacgtgccagaaaccgagagcacctacaactgctacgagaagatggagtacaaactgctccccggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagacaagcatctttaactacgacatcatcaaggataagagattcaccgtggacaaatttcagtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagaagaaagtcgccgcccagacctggaacaccatcgagaatatcaaggaactgaaagctggatacatgagccaggtggtgcataaaattacacagctgatgatggaatacaacgcaatcgtcgtgctcgaggatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtg

SEQ ID NO: 580 - DNA, 3681 bp, synthetic construct
  source 1..3681: mol_type = other DNA
atgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctggagagctcgaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacaatgccgaactgctgagaggatgggatctgaacagagagacatctaaggcctccatcattctgaagaaggacaatctgtactatctcggaatcatgaagaagtctgatagacgggtgttcctgaacgtgccagaaaccgagagcacctacaactgctacgagaagatggagtacaaactgctcccgggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagacaagcatctttaactacgacatcatcaaggataagagattcaccgtggacaaatttcagtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagcgcaaagtcgccagacagacctggaacaccatcgagaatatcaaggaactgaaagctggatacatgagccaggtggtgcataaaattacacagctgatgatggaatacaacgcaatcgtcgtgctggaagatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtg

SEQ ID NO: 581 - DNA, 3681 bp, synthetic construct
  source 1..3681: mol_type = other DNA
atgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctgggacgctagaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacagagccgagctcctgaccggatgggatctgaacaaggagacatctaaggcctccatcattctgaagaaggacaatctgtactatctcggaatcatgaagaagtctgatagacgggtgttcctgaacgtgccagaaaccgagagcacctacaactgctacgagaagatggagtacaaactgctccccggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagactagtatctttaactacgacatcatcaaggataagagattcaccgtggacaaatttctgtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagcgcaaagtcgccagacagacctggaacaccatcgagaatatcaaggaactgaaagctggatacatgagccaggtggtgcataaaattacacagctgatgatggaatacaacgcaatcgtcgtgctggaagatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtg

SEQ ID NO: 582 - DNA, 3681 bp, synthetic construct
  source 1..3681: mol_type = other DNA
atgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctgggacgctagaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacagagccgagctcctgaccggatgggatctgaacaaggagacatctaaggcctccatcattctgaagaaggacaatctgtactatctcggaatcatgaagaagtctgatagacgggtgttcctgaacgtgccagaaaccgagagcacctacaactgctacgagaagatggagtacaaactgctccccggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagacaagcatctttaactacgacatcatcaaggataagagattcaccgtggacaaatttcagtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagcgcaaagtcgccagacagacctggaacaccatcgagaatatcaaggaactgaaagctggatacatgagccaggtggtgcataaaattacacagctgatgatggaatacaacgcaatcgtcgtgctggaagatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtg

SEQ ID NO: 583 - DNA, 3681 bp, synthetic construct
  source 1..3681: mol_type = other DNA
atgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctgggacgctagaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacaatgccgaactgctgaccggatgggatctgaacaaggagacatctaaggcctccatcattctgaagaaggacaatctgtactatctcggaatcatgaagaagtctgatagacgggtgttcctgaacgtgccagaaaccgagagcacctacaactgctacgagaagatggagtacaaactgctccccggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagactagtatctttaactacgacatcatcaaggataagagattcaccgtggacaaatttctgtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagcgcaaagtcgccagacagacctggaacaccatcgagaatatcaaggaactgaaagctggatacatgagccaggtggtgcataaaattacacagctgatgatggaatacaacgcaatcgtcgtgctggaagatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtg

SEQ ID NO: 584 - protein, 1293 aa, synthetic construct; identical to SEQ ID NO: 334

SEQ ID NO: 585 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHRNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDCPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 586 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHRNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDCPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSKDAAAKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 587 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHRNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDCPTLARGWDENRESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 588 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHDNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDRPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 589 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHDNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDNPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYLFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 590 - protein, 1293 aa, synthetic construct
MARIIDEFCGQMNGYSRSITLRNRLVPIGKTEENLKQFLEKDLERATAYPDIKNLIDAIHRNVIEDTLSKVALNWNEIFNILATYQNEKDKKKKAAIKKDLEKLQSGARKKIVEAFKKNPDFEKLFKEGLFKELLPELIKSAPVDEIAVKTKALECFNRFSTYFTGFHDNRKNMYSEEAKSTAISYRIVNENFPKFFANIKLFNYLKEHFPRIIIDTEESLKDYLKGKKLDSVFSIDGFNSVLAQSGIDFYNTVIGGISGEAGTKKTQGLNEKINLARQQLSKEEKNKLRGKMVVLFKQILSDRETSSFIPVGFANKEEVYSTVKEFNNSIAEKAVSKVRDLFLHREEFTLNEIFVPAKSLTDFSQAIFGSWSILSEGLFLLEKDSMKKALSESQEEKINKEIAKKDCSFTELQLAYERYCTEHNLPVEKFCKDYFDIVDYRGNGAKSEKTKVSILSEILETFLQLDFDHIQDLQQEKNAAIPIKAYLDEVQNLYHHLKLVDYRGEEQKDSTFYSKHDEILTDLSQIVPLYNKVRNFVTKKLGESKKIKLNFDCPTLANGWDENQESSNDAIILRKDGKYYLGIYNPNNKPKFAKKDSIVGDCYEKMAYKQIALPMGLGAFVRKCFGTAQKYGWGCPENCLNSEGKIIIKDEEAKGNLEAIIDCYKDFLNKYEKDGFKYKDYNFSFLDSASYEKLSDFFNDVKPQGYKLSFTSIPLSEIDKMIDEGKLFLFQIYNKDFAKKATGKKNLHTLYWENLFSVENLQDVVLKLNGEAELFWREASIKKDKVIVHKKGSILVNRTTTDGKSIPEAIYQEIYQLKNKMADSISDEAKRLLESGTVVCKVATHDIVKDKHFTENTYQFHCPITMNFKAKDRTNKEFNNHVLEVLNKNPDIKVIGLDRGERHLLYLSLINQKGEIECQKTLNLVEQVRNDKTVSVNYHEKLVHKEGSRDAARKNWQTIGNIKELKEGYLSAVVHEIASLMVKHNAIVVMEDLNFGFKRGRFAVERQIYQKFENMLIEKLNYLVFKDRKVTEPGGVLNAYQLANKSAKVTDVYKQCGWLFYIPAAYTSKIDPRTGFANLFITKGLTNVEKKKEFFGKFDSIRYDATESCFVFSFDYAKICDNADYKKKWDVYTRGTRLVYNKTERKNVSVNPTEELQCVFDEFGIKWNTGEDLIESISLIPAEKSNAKFFDVLLRMFNATLQMRNSVPNTDTDYLVSPVKAEDGSFFDSREEFKKGGDARLPIDCDANGAYHIALKGLYLLLNDFNRDNKGVIQNISNKDWFKFVQEKVYKD

SEQ ID NO: 591 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNRNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 592 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNRNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKEKDKAAKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 593 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNRNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLRGWDKNRESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 594 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDRPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFLLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 595 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDRPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFSLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 596 - protein, 1227 aa, synthetic construct
MKEQFINCYPLSKTLRFSLIPVGKTEDNFNKKLLLESDKQRAENYENVKSYIDRFHKEYIKSALANARIEKINEYAALYWKNNKDDSDAKAMESLEDDIRKQISKQLTSTANFKRLFGKELICEDLPAFLTDENEKETVECFRSFTTYFNGFNTNRKNMYSSEKKSTAIAYRCVNDNLPRFLDNIKTFQKIFDNLSDETITKLNTDLYNIFGRKIEDIFSVDYFDFVLTQSGIDIYNYMIGGYTCSDGTKIQGLNECINLYNQQVAKNEKSKRLPLMKPLRKQILSEKDSVSFIPEKFNSDNEVLLAIEEYYNNHISDIDSLTELLQSLNTYNANGIFIKSGAAVSDISNAAFNSWNVLRLAWNEKYEALHPVTSTTKIDKYIEKRDKVYKSIKSFSLFELQELGAENGNEITDWYISSINECNRKIKETYLQARELLESDYEKDYDKRLYKNEKATELVKNLLDAIKEFQQLVKLLNGTGKEENKDELFYGKFTSLYDSVADIDRLYDKVRNYITQRPYSKDKIKLNFDNPQLLGGWDKNKESDYRTVILRKNDFYYLAVMDKSHSKVFVNAPEITSEDEDYYEKMEYKLLPGPNKMLPKVFFASRNIDKFQPSDRILDIRKRESFKKGATFNKSECHEFIDYFKESIKKHDDWSKFGFEFSPTESYNDISEFYREVSDQGYYISFSKISKNYIDKLVENGYLYLFKIYNKDFSKYSKGTPNLHTLYFKMLFDERNLSNVVYKLNGEAEMFYREASINDKEKITHHANQPIKNKNPDNEKKESVFEYDIVKDKRFTKRQFLLHVSVTINFKAHGQEFLNYDVRKAVKYKDDNYVIGIDRGERNLIYISVINSNGEIVEQMSLNEIIGDNGYSVDYQKLLDKKEKERDKARKNWTSVENIKELKEGYISQVVHKICELVVKYDAVIAMEDLNFGFKRGRFPVEKQVYQKFENMLISKLNLLIDKKAEPTETGGLLRAYQLTNKFDGVNKAKQNGIIFYVPAWDTSKIDPVTGFVNLLKPKYTSVREAKKLFETIDDIKYNTNTDMFEFCIDYGKFPRCNSDFKKTWTVCTNSSRILSFRNEKKNNEWDNKQIVLTDEFKSLFNEFGIDYTSDLKASILSISNADFYNRLIRLLSLTLQMRNSIIGSTLPEDDYLISPVANDRGEFYDSRNYKGSNAALPCDADANGAYNIARKALWAINVLKDTPDDMLQKAKLSITNAEWLEYTQR

SEQ ID NO: 597 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWRARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDNAELLTGWDLNKETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFQFHVPITLNFQAIDRKSDINLRMRQEIKKNKDMHIIGIDRGERNLLYISIIDLDGNIVKQESLNTITNEYDGKIYTTDYHKLLDKKEEKRKVARQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 598 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWRARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDNAELLTGWDLNKETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFQFHVPITLNFQAIDRKSDINLRMRQEIKKNKDMHIIGIDRGERNLLYISIIDLDGNIVKQESLNTITNEYDGKIYTTDYHKLLDKKEEKKKVAAQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 599 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWRARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDNAELLRGWDLNRETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFQFHVPITLNFQAIDRKSDINLRMRQEIKKNKDMHIIGIDRGERNLLYISIIDLDGNIVKQESLNTITNEYDGKIYTTDYHKLLDKKEEKRKVARQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 600 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWDARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDRAELLTGWDLNKETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFLFHVPITLNFQAIDRKSDINLRMRQEIKKNKDMHIIGIDRGERNLLYISIIDLDGNIVKQESLNTITNEYDGKIYTTDYHKLLDKKEEKRKVARQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 601 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWDARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDRAELLTGWDLNKETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFQFHVPITLNFQAIDRKSDINLRMRQEIKKNKDMHIIGIDRGERNLLYISIIDLDGNIVKQESLNTITNEYDGKIYTTDYHKLLDKKEEKRKVARQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 602 - protein, 1227 aa, synthetic construct
MKAELFKTFVDEYPVSKTLRFSLIPVGRTLENIEKDGILDCDEKRSEEYKRVKKLLDEYYKTFIEHALTNVELDINSLEEYERLYNIKNKSDKEKADFDSVQKNLRKQIVKALKEDEKYKFLFKKEIIEKELVDFLNGRDSDVELVKSFKGYATMFQGFWDARKNIFSDEEKSTAIAYRIINENLPKFISNKNIYFTKIQPEMDAELDQLTLSNNSNEIRDIFKLEYFSKTITQTGIEIYNGILGGYTIDEQVKLQGINEIVNLHNQKNKDSGKIPKLKMLYKQILSDTNTLSFIAEGFETDDEVLESLNIFYDVFNENILDEDLGIINLLRNIDKFSYDGIYIKNDKALIDISNYLFGDWHYIKNAINKKYEIDNPGKNTEKYIVKRNKFIKSFDSFSLKYLQDCTGSKFNEHILIKINNLIDDVKKAYNSVALLIKNKYEGTNLINDKDAIEKIKQFLDSMKSLVSFIRCFEGTGQEPDRDEIFYGEFDTGKKTFYYLNNIYNKTRNYVTKKPYSIEKYKLNFDNAELLTGWDLNKETSKASIILKKDNLYYLGIMKKSDRRVFLNVPETESTYNCYEKMEYKLLPGPNKMLPKVFFAKSNIDYYDPSPEIMRIYKEGTFKKGDNFNIDDCHDLIDYFKESLDKNDDWKIFDFDFSETSSYKDIGEFYKEVQQQGYKISFKNIASSYVDELVENGKLYLFQIYNKDFSKNSKGTENLHTMYWRALFDEENLENVIYKLNGDAEIFFRRKSISENEKIVHPAHVEIENKNDETRKEKKTSIFNYDIIKDKRFTVDKFLFHVPITLNFQAIDRKSDINLRMRQEIKKNKDMHIIGIDRGERNLLYISIIDLDGNIVKQESLNTITNEYDGKIYTTDYHKLLDKKEEKRKVARQTWNTIENIKELKAGYMSQVVHKITQLMMEYNAIVVLEDLNTGFKRGRQKVEKQIYQAFEKALINKLNYYVDKKVDKNEISGLYKPLQLTKEFESFKKLGKQSGAIFYVPAWNTSKMDPTTGFVNLLSVKYENMEKSKEFINKIKDINFKEDDCGKYYEFHIDFNEFTDKGKDTKTDWNICSFGKRIDNARNQKGDFESKMIDLTNEFHNLFKKYGINDNSNLKEDILNVKEAKFYKEFINLFKLMLQIRNSESNEKVDFLQSPVKNNKGEFFNSNNVNGNEAPENADANGAYNIARKGLWIVNQIKTMPDSQMHKIKLAMKNQEWLLFAQKGNV

SEQ ID NO: 603 - RNA, 3891 nt, synthetic construct
  source 1..3891: mol_type = other RNA
ggaaataagagagaaaagaagagtaagaagaaatataagagccaccatgagcaagctggagaagtttacaaactgctactccctgtctaagaccctgaggttcaaggccatccctgtgggcaagacccaggagaacatcgacaataagcggctgctggtggaggacgagaagagagccgaggattataagggcgtgaagaagctgctggatcgctactatctatcttttatcaacgacgtgctgcacagcatcaagctgaagaatctgaacaattacatcagcctgttccggaagaaaaccagaaccgagaaggagaataaggagctggagaacctggagatcaatctgcggaaggagatcgccaaggccttcaagggcaacgagggctacaagtccctgtttaagaaggatatcatcgagacaatcctgccagagttcctggacgataaggacgagatcgccctggtgaacagcttcaatggctttaccacagccttcaccggcttctttgataacagagagaatatgttttccgaggaggccaagagcacatccatcgccttcaggtgtatcaacgagaatctgacccgctacatctctaatatggacatcttcgagaaggtggacgccatctttgataagcacgaggtgcaggagatcaaggagaagatcctgaacagcgactatgatgtggaggatttctttgagggcgagttctttaactttgtgctgacacaggagggcatcgacgtgtataacgccatcatcggcggcttcgtgaccgagagcggcgagaagatcaagggcctgaacgagtacatcaacctgtataatcagaaaaccaagcagaagctgcctaagtttaagccactgtataagcaggtgctgagcgatcgggagtctctgagcttctacggcgagggctatacatccgatgaggaggtgctggaggtgtttagaaacaccctgaacaagaacagcgagatcttcagctccatcaagaagctggagaagctgttcaagaattttgacgagtactctagcgccggcatctttgtgaagaacggccccgccatcagcacaatctccaaggatatcttcggcgagtggaacgtgatccgggacaagtggaatgccgagtatgacgatatccacctgaagaagaaggccgtggtgaccgagaagtacgaggacgatcggagaaagtccttcaagaagatcggctccttttctctggagcagctgcaggagtacgccgacgccgatctgagtgtggtggagaagctgaaggagatcatcatccagaaggtggatgagatctacaaggtgtatggctcctctgagaagctgttcgacgccgattttgtgctggagaagagcctgaagaagaacgacgccgtggtggccatcatgaaggacctgctggattctgtgaagagcttcgagaattacatcaaggccttctttggcgagggcaaggagacaaacagggacgagtccttctatggcgattttgtgctggcctacgacatcctgctgaaggtggaccacatctacgatgccatccgcaattatgtgacccagaagccctactctaaggataagttcaagctgtattttcagaaccctcagttcatgggcggctgggacaaggataaggagacagactatcgggccaccatcctgagatacggctccaagtactatctggccatcatggataagaagtacgccaagtgcctgcagaagatcgacaaggacgatgtgaacggcaattacgagaagatcaactataagctgctgcccggccctaataagatgctgccaaaggtgttcttttctaagaagtggatggcctactataaccccagcgaggacatccagaagatctacaagaatggcacattcaagaagggcgatatgtttaacctgaatgactgtcacaagctgatcgacttctttaaggatagcatctcccggtatccaaagtggtccaatgcctacgatttcaacttttctgagacagagaagtataaggacatcgccggcttttacagagaggtggaggagcagggctataaggtgagcttcgagtctgccagcaagaaggaggtggataagctggtggaggagggcaagctgtatatgttccagatctataacaaggacttttccgataagtctcacggcacacccaatctgcacaccatgtacttcaagctgctgtttgacgagaacaatcacggacagatcaggctgagcggaggagcagagctgttcatgaggcgcgcctccctgaagaaggaggagctggtggtgcacccagccaactcccctatcgccaacaagaatccagataatcccaagaaaaccacaaccctgtcctacgacgtgtataaggataagaggttttctgaggaccagtacgagctgcacatcccaatcgccatcaataagtgccccaagaacatcttcaagatcaatacagaggtgcgcgtgctgctgaagcacgacgataacccctatgtgatcggcatcgataggggcgagcgcaatctgctgtatatcgtggtggtggacggcaagggcaacatcgtggagcagtattccctgaacgagatcatcaacaacttcaacggcatcaggatcaagacagattaccactctctgctggacaagaaggagaaggagaggttcgaggcccgccagaactggacctccatcgagaatatcaaggagctgaaggccggctatatctctcaggtggtgcacaagatctgcgagctggtggagaagtacgatgccgtgatcgccctggaggacctgaactctggctttaagaatagccgcgtgaaggtggagaagcaggtgtatcagaagttcgagaagatgctgatcgataagctgaactacatggtggacaagaagtctaatccttgtgcaacaggcggcgccctgaagggctatcagatcaccaataagttcgagagctttaagtccatgtctacccagaacggcttcatcttttacatccctgcctggctgacatccaagatcgatccatctaccggctttgtgaacctgctgaaaaccaagtataccagcatcgccgattccaagaagttcatcagctcctttgacaggatcatgtacgtgcccgaggaggatctattcgagtttgccctggactataagaacttctctcgcacagacgccgattacatcaagaagtggaagctgtactcctacggcaaccggatcagaatcttccggaatcctaagaagaacaacgtgttcgactgggaggaggtgtgcctgaccagcgcctataaggagctgttcaacaagtacggcatcaattatcagcagggcgatatcagagccctgctgtgcgagcagtccgacaaggccttctactctagctttatggccctgatgagcctgatgctgcagatgcggaacagcatcacaggccgcaccgacgtggattttctgatcagccctgtgaagaactccgacggcatcttctacgatagccggaactatgaggcccaggagaatgccatcctgccaaagaacgccgacgccaatggcgcctataacatcgccagaaaggtgctgtgggccatcggccagttcaagaaggccgaggacgagaagctggataaggtgaagatcgccatctctaacaaggagtggctggagtacgcccagaccagcgtgaagcacaaaaggccggcggccacgaaaaaggccggccaggcaaaaaagaaaaagtaatgataataggctggagcctcggtggccatgcttcttgccccttgggcctccccccagcccctcctccccttcctgcacccgtacccccgtggtctttgaataaagtctga

SEQ ID NO: 604 - RNA, 4086 nt, synthetic construct
  source 1..4086: mol_type = other RNA
ggaaataagagagaaaagaagagtaagaagaaatataagagccaccatggccagaataattgacgaattctgcggacagatgaacgggtattcaagaagcataacactgagaaaccggctggtccctatcggcaagacagaggagaatctgaagcaatttctggagaaggacctggagcgggccacggcctatcctgacatcaagaacctgatcgatgccatccaccggaacgtgattgaggacaccctgagcaaggtggccctgaactggaatgaaattttcaatatcctggccacctaccagaacgagaaggataagaaaaaaaaagctgccattaagaaggacctggaaaagctccaaagcggcgccagaaaaaagatagtggaggcttttaagaagaaccccgatttcgagaagctgttcaaggaaggactgttcaaggaactgctgcctgagctgatcaaaagcgctcctgtggacgagatcgccgttaagaccaaggctctggagtgcttcaacaggttcagcacctactttaccggcttccacgacaacagaaagaacatgtacagcgaagaagccaagagcacagccatctcttatagaatcgtgaacgaaaatttccccaagttcttcgcaaacatcaagctattcaactacctgaaggagcacttccctagaatcataatcgataccgaggaatctctgaaggactacctgaagggcaagaagctggatagcgtgttctctatcgatggcttcaactctgtgctggctcagagcggcatcgatttctacaacaccgtgatcggaggaattagcggagaggccggcaccaagaagacacagggcttaaatgagaagattaacctggccagacagcagctgagcaaggaagagaagaataagctgagaggaaagatggtggtgctgtttaaacagatcctgagcgacagagaaacctcttctttcatccctgttggctttgccaataaggaagaggtctacagcaccgtgaaggagttcaataacagcatcgctgagaaagccgtgagcaaggtgcgggacttgttcctgcacagagaggaattcaccctgaatgagatcttcgttcctgccaaaagcctgacagatttctctcaggccatctttggaagctggagcatcctgtctgagggcctgttcctgcttgaaaaggacagcatgaagaaagccctgtctgaaagccaggaggaaaagatcaacaaggaaatcgccaagaaggactgcagcttcaccgaactgcagctcgcctacgagagatactgcaccgagcacaacctacccgtggagaaattctgtaaagattactttgacatcgttgactatagaggcaacggagctaagagcgagaagacgaaggtgagcatcctgtccgagatcctggaaacattcctccaactggactttgaccacatccaggacctgcaacaggagaagaacgccgccatccccatcaaggcatacctggacgaagtgcagaacctgtaccaccacctgaagctggtggactaccggggagaggaacagaaggattctaccttctacagcaagcacgacgagattctcaccgatctgagccagattgtgcctctgtacaacaaggtacggaactttgtgaccaaaaagctgggcgagagcaagaagattaagctgaacttcgactgtcctaccctggccaacggctgggatgagaatcaggagagcagcaacgacgcgatcatcctgcggaaggacggcaagtactacctgggcatctacaaccctaataacaagcccaagttcgccaagaaagacagtatcgtgggcgactgctacgagaagatggcctacaagcagattgccctgccaatgggcctcggcgccttcgtgagaaagtgcttcggcaccgcacagaagtacggctggggatgtcctgagaactgcctgaactccgaaggcaagatcatcatcaaggacgaggaagccaagggcaacctcgaagccatcatcgactgctacaaagacttcctgaacaagtacgagaaggatggattcaagtacaaggactacaacttcagcttcctggactctgccagctacgagaaactgagcgacttcttcaacgacgtcaagcctcagggctacaagctgagctttaccagcatcccactgagcgaaatcgataagatgatcgacgagggcaaactgtttctgtttcagatctacaataaagacttcgccaagaaggccacaggcaaaaagaacctgcacaccctgtactgggagaatctattttctgtcgagaacctgcaagatgtggtgctgaagttgaacggcgaggccgaactgttctggcgggaggctagtatcaagaaggataaggtgatcgtgcataagaagggcagtatccttgtgaaccgaaccaccaccgacggcaagagcatcccagaagccatctaccaggagatttaccagctgaagaacaagatggccgatagcatcagcgacgaggccaaaagactgctggagtccggcacagtggtgtgcaaggtcgcgacacacgatatcgtgaaggacaaacacttcacagagaacacatacctgttccactgtcctatcaccatgaactttaaggccaaggacagaacaaataaagaattcaacaaccacgtgctggaggtgctgaacaagaaccccgatatcaaagtgatcggactggacagaggagagagacacctgctgtacctgtccctgatcaaccagaaaggcgagatcgagtgtcagaaaacactgaacctggtcgagcaggtgcggaacgacaagaccgtgtccgtgaattaccatgagaagctggtgcacaaggaggggtcccgtgacgccgcccgcaagaactggcagaccatcggcaatatcaaggagctgaaagaaggctacctgagcgctgtggtgcatgagatcgctagcctgatggtcaaacacaacgccatcgtggtgatggaagatctgaatttcggctttaagcggggtagattcgctgtggaacggcagatctaccaaaagttcgagaatatgctgatcgagaaacttaactacctggtattcaaagataggaaggtgaccgagcccggcggagtgctgaacgcctatcagctcgctaacaagagcgccaaggtgacagacgtgtacaagcagtgtggctggctgttctacatccctgctgcctacaccagcaagatcgaccccagaaccggcttcgccaatctattcatcaccaagggtctgaccaacgtggaaaagaagaaagaattcttcggcaagtttgactcgataaggtacgacgccacagagagctgcttcgtgttcagcttcgattacgccaaaatctgcgacaacgcggactataagaaaaagtgggacgtgtatacaagaggcaccagacttgtgtacaacaaaaccgaaagaaaaaacgtgtcagtgaaccctacagaggaactgcagtgcgtgttcgatgaattcggcatcaagtggaacaccggcgaggatctgatcgagagcatcagcctgatccccgccgagaagtctaacgccaagttcttcgacgtgctgctgagaatgttcaacgccacactgcagatgagaaacagcgtgccaaacaccgacaccgactacctggtgtcccctgtgaaggccgaggacggcagcttctttgatagcagagaggaattcaaaaagggcggcgatgcccggctgcctatcgattgcgacgccaacggcgcctaccacattgccctgaagggcctgtacctgctgctgaacgatttcaatagagataataaaggcgtgatccaaaacatctctaacaaggactggttcaagttcgtgcaggagaaggtgtacaaggacaaaaggccggcggccacgaaaaaggccggccaggcaaaaaagaaaaagtaatgataataggctggagcctcggtggccatgcttcttgccccttgggcctccccccagcccctcctccccttcctgcacccgtacccccgtggtctttgaataaagtctga

SEQ ID NO: 605 - RNA, 3888 nt, synthetic construct
  source 1..3888: mol_type = other RNA
ggaaataagagagaaaagaagagtaagaagaaatataagagccaccatgaaggaacaattcatcaattgctaccccctgagcaaaacactgagattcagcctgatccccgtcggaaaaacagaggacaatttcaacaaaaagttgttgctggaaagcgataagcagagagccgaaaactacgagaacgtgaaaagctacatcgatcgattccacaaggagtacatcaagagcgccctggccaatgctagaatcgagaagatcaatgaatacgccgctctgtactggaagaacaacaaggatgatagtgatgccaaggccatggagagcctcgaggacgacatccgcaagcagatctctaaacagctgactagcaccgccaatttcaagagactgtttgggaaggagctgatctgcgaggacctgccggcctttctgactgatgagaacgagaaggaaaccgtggaatgcttcagaagcttcaccacgtactttaacggcttcaacaccaacagaaagaatatgtactctagcgagaagaagtccacagccatcgcctatagatgcgtgaacgataatctgcctagatttctggacaatatcaagacattccagaagatcttcgacaacctgtccgatgagacaatcacaaagctgaatacagatctatacaatatcttcggcagaaagatcgaagacatttttagcgtggactatttcgatttcgtactgacccagtccggcattgacatctacaactacatgatcggcggatacacctgcagcgacggcaccaaaattcagggcctaaatgagtgtatcaacctgtataaccagcaggtggccaagaatgagaaaagcaagcgcctgcctctgatgaagccactgagaaagcagatcctgtctgaaaaagattctgtgtctttcatccccgaaaagttcaacagcgacaacgaggtgctgctcgccatcgaagagtattacaacaaccacatctccgacatcgacagcctgaccgagctgctgcagagcctgaatacctacaacgccaacggcatcttcatcaaatcaggcgccgccgtgtcagacatcagcaacgccgcttttaacagctggaacgtgctgaggctggcctggaacgaaaagtacgaggccctgcatcctgtgaccagcaccaccaagatcgacaaatacatcgagaaaagggacaaggtgtacaagagcatcaagtccttcagcctgttcgagctgcaagagctgggagctgagaacggcaacgagatcaccgactggtacatctccagcatcaacgagtgcaacagaaaaataaaagaaacctacctgcaggccagagagctgctggagagcgactatgagaaggactatgataaacggctgtacaaaaacgaaaaggccacagagctggtgaagaatctgctggacgccatcaaggaatttcagcaactggtgaagctcctgaacggtacaggcaaggaggaaaacaaggatgagctcttttacggcaagttcacatctctctacgacagcgttgccgatatcgatagactttacgacaaagtgcggaactacattacacagcggccttactctaaggacaaaatcaagctgaacttcgacaacccccagttgctgggcggatgggataaaaacaaggaaagcgactacagaaccgtgatcctgaggaagaacgacttttattacctggctgtgatggacaaaagccacagcaaggtgttcgtgaacgcccctgagatcaccagcgaagatgaggactactacgagaagatggaatataagctgctgccaggccccaataagatgctgcctaaggtgttcttcgcctcccggaatatcgacaagttccagcctagcgaccgcatcctggatattcggaagcgggaatcttttaagaagggcgccaccttcaacaagtccgaatgccacgagtttatcgactacttcaaggaatcaattaagaagcacgacgactggtccaagttcggctttgagttctctcctaccgagagctacaacgatatcagtgagttctacagagaggtgagcgatcagggctactacatcagcttcagcaagatcagtaagaactacatcgacaaacttgtggagaatggctacctgtacctgtttaaaatctacaacaaggacttcagcaaatactccaagggcacacctaacctgcataccctgtacttcaagatgctgttcgacgagcggaacctcagcaacgtggtctacaaactgaacggagaggccgagatgttctacagagaagctagcattaacgacaaggaaaagatcacccaccacgccaaccagcctatcaagaacaagaatcctgataacgagaaaaaggaaagcgtgtttgagtacgacatcgtgaaggataagagattcaccaagcggcagttcagcctgcacgtgtctgtcacaatcaatttcaaagcccacggacaggagttcctgaactacgacgtgcggaaggctgtgaagtacaaggacgacaactacgtgatcggcatcgatagaggcgagagaaacctgatctacatcagcgttatcaacagcaacggcgagatcgtggaacagatgagcctgaacgaaatcattggcgacaacggctactctgtggactatcagaagctgctggacaagaaagagaaggaaagagataaggcgagaaagaattggacctccgtcgagaacatcaaggaactgaaggagggctacatcagccaggtggtgcacaagatatgtgaactggtggtgaagtacgatgccgtgatcgccatggaagatctgaacttcggattcaaaagaggcagattccccgtggaaaagcaagtgtaccagaagttcgaaaacatgctgatcagcaagctgaacctgctgattgacaagaaagcagagcctacagagaccggcggcctgctgcgggcctaccaactgacaaacaagttcgacggcgtgaacaaagccaagcagaacggcatcatcttctacgtgcctgcctgggacacctctaagatcgaccctgtgactggcttcgtgaacctgctgaagcccaagtatacctcggtgcgggaggccaagaagctgttcgagaccatcgacgatatcaagtacaacaccaacacagacatgttcgagttctgcatcgattacggcaaattccctagatgtaacagcgacttcaagaaaacctggacagtgtgcaccaactctagccggatcctgagcttcagaaacgaaaagaaaaacaacgagtgggacaacaagcaaatcgtcctgaccgacgaattcaagtctctgttcaacgagtttggcatcgattacacctcggacctgaaagctagcatcctgtctatcagcaacgctgacttctacaatagactgatccggctgctatctctgacactgcagatgcgtaacagcatcatcggtagcaccctgcccgaggacgactacctgatcagccctgtggccaacgaccggggagaattctacgacagcagaaactacaaaggctccaacgccgcccttccatgtgacgccgacgccaacggcgcttacaatatcgcccggaaagccctgtgggctatcaacgtgctgaaggatacccctgacgatatgctgcagaaggccaagctcagcatcaccaatgccgagtggctggaatacacccagagaaaaaggccggcggccacgaaaaaggccggccaggcaaaaaagaaaaagtaatgataataggctggagcctcggtggccatgcttcttgccccttgggcctccccccagcccctcctccccttcctgcacccgtacccccgtggtctttgaataaagtctga

SEQ ID NO: 606 - RNA, 3889 nt, synthetic construct
  source 1..3889: mol_type = other RNA
gggaaataagagagaaaagaagagtaagaagaaatataagagccaccatgaaggccgagctgttcaagacattcgtggacgaataccccgtgtctaagacactgcggttcagcctgattcctgtgggcagaaccctggaaaacatcgaaaaggacggcatcctggattgtgatgagaagcgatctgaagaatacaagagagtgaagaagctgctggatgaatactacaagacattcatcgagcacgccctgaccaatgtagaactggatatcaactccctggaagaatacgagagactctacaacatcaaaaacaagtcagacaaggaaaaggccgattttgacagcgtgcagaaaaacctaaggaaacagattgtgaaggccctgaaggaggatgagaagtacaagttccttttcaagaaggaaatcatcgagaaggaactggtagattttctgaacggcagagacagcgatgtggagctggtcaagtccttcaagggctacgctaccatgttccaaggcttctgggacgctagaaagaatatcttcagcgacgaagagaaaagcaccgccatcgcctacagaatcatcaacgaaaatctgcctaagtttatctctaataaaaacatctacttcaccaagatccagcctgagatggatgccgagctggaccagctgacactgagcaacaacagcaatgagatcagagatatctttaagctggagtatttcagcaaaaccatcacccagacaggcatcgagatctataatggaattctgggcggatacaccatcgatgaacaggtgaaactgcagggaatcaacgagatcgtgaacctgcataatcagaagaacaaggacagtggcaagatcccaaagctgaagatgctgtataagcagatcctgagcgatacaaacacgctgtcattcatcgccgaaggctttgagaccgatgacgaggttctggaatcgcttaatattttctacgacgtgttcaacgagaacatcctggacgaggacctgggtataatcaacctgctgagaaacatcgataagttctcctacgatgggatctacatcaagaatgacaaggccctgatcgacatcagcaactacctgttcggtgactggcactacatcaaaaacgccatcaataaaaaatatgagatcgataaccctggcaagaacacagagaagtacatcgtgaaaagaaataaattcatcaagagcttcgactctttcagcctgaagtacctgcaggactgtacaggcagcaagttcaacgagcacatcctgatcaagatcaacaacctgatcgacgacgtgaagaaggcttacaacagcgtcgccctgctgatcaagaacaagtacgagggaaccaacctgatcaacgacaaggacgccatcgagaagatcaagcaatttctggacagcatgaagagcctggtgtccttcatcagatgcttcgaaggcacaggccaggagcctgacagagatgaaatcttctacggcgagttcgataccggcaagaagaccttctactacctgaacaacatctacaacaagaccagaaactacgtgaccaagaagccctacagcatcgagaaatacaagctgaacttcgacaatgccgaactgctgaccggatgggatctgaacaaggagacatctaaggcctccatcattctgaagaaggacaatctatactatctcggaatcatgaagaagtctgatagacgggtgttcctgaacgtgccagaaaccgagagcacctacaactgctacgagaagatggagtacaaactgctccccggccctaacaaaatgctgcctaaggtcttcttcgccaaaagtaacatcgactactacgaccctagccccgagattatgcggatctacaaggagggcaccttcaaaaagggggataacttcaacattgacgactgccacgacttaatcgactacttcaaagagagcctggacaagaacgacgattggaaaatcttcgattttgacttcagcgagacaagcagctacaaggacatcggagaattctataaggaagttcagcagcagggctacaaaatcagctttaagaacatcgccagcagctatgtggacgagcttgtggagaacggaaagctgtacctgttccagatctacaacaaggacttttctaagaactctaaaggcaccgagaacctgcacacaatgtactggcgggccctgttcgacgaggagaacctggaaaatgtgatctacaagctgaacggcgacgccgagatctttttcagaagaaaatccatatccgagaacgagaagatcgtgcacccagcccacgtggagattgagaataaaaatgacgagactcggaaggaaaaaaagacaagcatctttaactacgacatcatcaaggataagagattcaccgtggacaaatttcagtttcacgtgcccatcaccctgaactttcaggccatcgatcggaagagcgatatcaacctcagaatgcggcaggagatcaaaaagaacaaggacatgcacatcatcggcatagacagaggcgagagaaaccttctgtatatcagcatcatcgacctggacggcaatatcgttaagcaggagagcctcaacaccatcaccaacgaatacgacggcaagatttataccacagactatcacaagctgctcgacaagaaggaggagaagcgcaaagtcgccagacagacctggaacaccatcgagaatatcaaggaactgaaagctggatacatgagccaggtggtgcataaaattacacagctgatgatggaatacaacgcaatcgtcgtgctggaagatctaaacaccggcttcaagcggggcaggcaaaaggtggaaaagcagatctaccaggccttcgagaaagccctgatcaacaagctgaactactacgtggacaagaaggtggataagaacgaaataagcggcctgtacaagcctctgcagctgaccaaggagttcgaaagctttaaaaagctgggcaagcagtctggagccatcttctatgtgcctgcttggaacacaagcaagatggaccccaccaccggcttcgtgaatctgctgtctgtcaagtacgagaacatggaaaagtccaaagagttcatcaacaaaatcaaggacatcaacttcaaggaggatgactgcggcaaatactacgaatttcacatcgatttcaacgaattcaccgacaagggcaaggacaccaagaccgattggaatatctgcagctttggcaagcggatcgacaacgcaagaaatcagaaaggagatttcgagtccaagatgatcgacctgacaaacgagttccacaacctgttcaagaagtacggcatcaacgacaacagcaatctgaaggaggacatcctgaatgtgaaggaagctaaattttacaaggaattcatcaacctgttcaagctgatgctgcaaatccggaattctgagagcaatgaaaaggtggacttcctgcaaagtcctgtgaaaaacaacaagggcgagttcttcaactctaacaacgtgaacggcaacgaggcccctgagaatgccgacgccaacggcgcctacaacatagctagaaagggcctgtggatcgtgaaccagatcaagaccatgcctgatagccagatgcacaaaattaagctggccatgaagaaccaggaatggctgctgttcgcccagaagggcaacgtgaaaaggccggcggccacgaaaaaggccggccaggcaaaaaagaaaaagtaatgataataggctggagcctcggtggccatgcttcttgccccttgggcctccccccagcccctcctccccttcctgcacccgtacccccgtggtctttgaataaagtctga

SEQ ID NO: 607 - RNA, 4161 nt, synthetic construct
  source 1..4161: mol_type = other RNA
ggaaataagagagaaaagaagagtaagaagaaatataagagccaccatgacccagttcgaaggcttcaccaacctgtaccaggtgtccaagacactgcgcttcgagctgatcccacagggcaaaaccctgaaacacatccaggagcagggattcatcgaagaggacaaggccagaaacgaccactacaaggaactgaagcccatcatcgaccggatctacaagacatacgctgatcaatgtctgcagctggtgcagctggactgggagaacctgagcgccgccatcgatagctaccggaaggaaaaaaccgaagaaacccggaacgccctgatcgaggaacaggccacatacagaaacgccatccacgattacttcatcggcagaaccgacaacctgacagatgctatcaacaagcgccacgccgaaatctacaaaggcctgttcaaggccgagctgttcaacggtaaggtgctgaaacagctgggcaccgtgacaacgacggaacacgagaacgccctgctgagaagctttgacaagttcaccacctacttctctggcttttacgagaacagaaagaatgtgttcagcgccgaagatattagcaccgccatccctcacagaatagtccaggacaatttccctaagttcaaggaaaactgccacatctttaccagactcatcaccgctgtgccttctctgagagaacacttcgagaacgtgaagaaggcaatcggcatcttcgtgtctacctccatcgaggaggtctttagcttccctttctacaaccagctgctgacacagacacagatcgacctgtacaaccagctgttgggcggcatcagccgggaggccggcaccgagaagatcaaaggtctgaatgaggttctgaacctggcaatccagaagaacgacgagacagcccacatcatcgcctccctgcctcacagattcatccctctgttcaagcagatcctgagtgacagaaacaccctgagcttcattctggaagaattcaagagcgacgaggaagtgatccagagcttctgcaagtacaagaccctgctgagaaacgaaaatgtgctggagaccgccgaggccctgttcaacgagctgaacagcatcgacctgacccacatcttcatcagccacaagaagctggagaccatcagcagcgccctgtgtgaccactgggacaccctgcggaacgcgctgtacgagagacggatcagcgagctgaccggaaagatcacaaagtctgccaaggaaaaggtgcagcggtcccttaaacacgaggacataaacctgcaggagatcatctctgctgctggcaaggaactgagcgaggccttcaaacagaagacaagcgaaatcctgagccatgcccatgctgccctggatcagcctctgcctaccacactgaaaaagcaggaggaaaaggaaatcctgaagtctcagctggatagcctgctcggcctgtaccacctgctcgattggttcgccgtggatgagagcaacgaggtggaccccgaattctccgctcggctgaccggcattaagctggaaatggaacccagcctgagtttttataacaaggcccgcaactacgccaccaagaagccttacagcgtcgagaagtttaagttgaacttccagagaccgacactggccagcggctgggatgtcaacaaagaaaagaacaacggcgccatcctgtttgtgaagaacggcctgtactacctgggcatcatgcctaaacagaagggcagatacaaggccctgagcttcgagccaacagagaagacctctgaaggctttgataaaatgtactacgattacttccccgatgcagctaagatgatccccaaatgcagcacccaactgaaagccgtgaccgctcacttccagacacacacaacccctatcctgctgtccaacaacttcattgaacctctggaaatcaccaaagaaatctacgacctgaacaaccccgagaaggaacccaagaaattccagaccgcttacgcgaagaaaactggagaccagaagggctaccgagaggccctgtgcaagtggatcgacttcaccagagatttcctgagcaagtacaccaagacaaccagcatcgacctttcctctctgcggcctagctctcagtacaaggacctgggcgaatattacgccgagctgaaccctctgctgtaccacatcagctttcagcggatcgccgaaaaggagatcatggatgctgtggaaacaggaaagctctacctgtttcaaatctacaacaaggactttgcgaaaggccaccacggcaaacccaacctgcacaccttatactggaccggactgttctctcctgagaatctggccaagaccagcatcaagctgaacggccaggccgaactcttctacagacccaagagcagaatgaagagaatggcccacagactgggcgagaagatgctgaacaagaagctgaaagaccagaaaacacccattcctgacaccctgtaccaagagctgtacgactacgtgaatcacagactgagccacgacctgtccgacgaagccagagccctgctgcctaatgttatcacaaaagaggtatcccacgagatcatcaaggatagaagattcaccagcgacaagttcctcttccacgtgcccatcacgctgaattaccaggccgctaactctccaagcaaattcaaccagagggtgaacgcctacctgaaggagcaccctgagacccctatcatcggcatcgaccggggcgagaggaatctgatatacatcaccgtgatcgacagcacaggaaagatcctggaacagcggagcctgaacaccatccaacagtttgactaccaaaagaaactggataatagagagaaggaaagagtggctgccagacaggcttggagcgtggtgggaaccattaaggacctgaaacagggctacctgtctcaagtgatccatgagatcgtggacctgatgatccattaccaggccgtagtggtgctggaaaacctgaatttcggcttcaagagcaagagaacagggatcgccgagaaggccgtgtaccagcagttcgagaagatgctgatcgataagctaaactgcctggtgctgaaggactaccctgccgaaaaagtgggcggtgtgctgaacccctaccagctgaccgaccaattcaccagcttcgccaagatgggaacccagagcggcttcctgttctacgtgcctgccccttatacatctaaaattgatccactgacaggcttcgtggacccatttgtgtggaagacaataaagaaccacgaaagccgcaagcacttcttggagggcttcgacttcctgcattacgacgtcaagaccggagattttatcctgcacttcaagatgaaccggaacctgtctttccagcggggcctgcccggctttatgccagcctgggacatcgtgttcgagaaaaatgaaacccaatttgatgctaagggcacacccttcatcgccggcaagagaatcgtgcctgtgatcgagaaccatagatttaccggcagataccgcgacctgtatccagccaatgagctcatcgcgctcctggaggaaaagggaattgtgttcagagatggcagcaacatcctgcctaagctgcttgagaacgacgacagccacgccatcgacaccatggtggccctgattcggtccgtgctgcagatgagaaatagcaatgccgccaccggcgaggactacatcaacagccctgtgcgggacctgaacggcgtgtgcttcgacagcagattccaaaaccctgagtggcctatggacgccgacgccaacggcgcctatcacatcgccctgaagggccagctgctgctgaatcacctgaaggaatctaaagacttgaagctgcagaatggcatctcaaatcaagattggctggcttatatccaggagctccggaactccagagccgatcctaagaagaagagaaaggtgaaaaggccggcggccacgaaaaaggccggccaggcaaaaaagaaaaagtaatgataataggctggagcctcggtggccatgcttcttgccccttgggcctccccccagcccctcctccccttcctgcacccgtacccccgtggtctttgaataaagtctga

SEQ ID NO: 608 - DNA, 31 bp, synthetic construct
  source 1..31: mol_type = other DNA
cggcattcctgctgaaccgctcttccgatct

SEQ ID NO: 609 - DNA, 22 bp, synthetic construct
  source 1..22: mol_type = other DNA
gccagggttttcccagtcacga

SEQ ID NO: 610 - DNA, 28 bp, synthetic construct
  source 1..28: mol_type = other DNA
gaaattctaaacgctaaagaggaagagg

SEQ ID NO: 611 - DNA, 62 bp, synthetic construct
  source 1..62: mol_type = other DNA
ctacactctttccctacacgacgctcttccgatctagtcaataaacgctaaagaggaagagg

SEQ ID NO: 612 - DNA, 58 bp, synthetic construct
  source 1..58: mol_type = other DNA
ctacactctttccctacacgacgctcttccgatctattcctcggcattcctgctgaac

SEQ ID NO: 613 - DNA, 58 bp, synthetic construct
  source 1..58: mol_type = other DNA
ctacactctttccctacacgacgctcttccgatctgccaatcggcattcctgctgaac

SEQ ID NO: 614 - DNA, 58 bp, synthetic construct
  source 1..58: mol_type = other DNA
ctacactctttccctacacgacgctcttccgatctcttgtacggcattcctgctgaac

SEQ ID NO: 615 - DNA, 58 bp, synthetic construct
  source 1..58: mol_type = other DNA
ctacactctttccctacacgacgctcttccgatctttaggccggcattcctgctgaac

SEQ ID NO: 616 - DNA, 58 bp, synthetic construct
  source 1..58: mol_type = other DNA
ctacactctttccctacacgacgctcttccgatcttagcttcggcattcctgctgaac

SEQ ID NO: 617 - DNA, 58 bp, synthetic construct
  source 1..58: mol_type = other DNA
ctacactctttccctacacgacgctcttccgatctagttcccggcattcctgctgaac

SEQ ID NO: 618 - DNA, 58 bp, synthetic construct
  source 1..58: mol_type = other DNA
ctacactctttccctacacgacgctcttccgatctatcacgcggcattcctgctgaac

SEQ ID NO: 619 - DNA, 58 bp, synthetic construct
  source 1..58: mol_type = other DNA
ctacactctttccctacacgacgctcttccgatctgagtggcggcattcctgctgaac

SEQ ID NO: 620 - DNA, 58 bp, synthetic construct
  source 1..58: mol_type = other DNA
ctacactctttccctacacgacgctcttccgatctggctaccggcattcctgctgaac

SEQ ID NO: 621 - DNA, 58 bp, synthetic construct
  source 1..58: mol_type = other DNA
ctacactctttccctacacgacgctcttccgatctacagtgcggcattcctgctgaac

SEQ ID NO: 622 - DNA, 58 bp, synthetic construct
  source 1..58: mol_type = other DNA
ctacactctttccctacacgacgctcttccgatcttgaccacggcattcctgctgaac

SEQ ID NO: 623 - DNA, 58 bp, synthetic construct
  source 1..58: mol_type = other DNA
ctacactctttccctacacgacgctcttccgatctcagatccggcattcctgctgaac

SEQ ID NO: 624 - DNA, 58 bp, synthetic construct
  source 1..58: mol_type = other DNA
ctacactctttccctacacgacgctcttccgatctgatcagcggcattcctgctgaac

SEQ ID NO: 625 - DNA, 58 bp, synthetic construct
  source 1..58: mol_type = other DNA
ctacactctttccctacacgacgctcttccgatctcgatgtcggcattcctgctgaac

SEQ ID NO: 626 - DNA, 58 bp, synthetic construct
  source 1..58: mol_type = other DNA
ctacactctttccctacacgacgctcttccgatctccgtcccggcattcctgctgaac

SEQ ID NO: 627 - DNA, 58 bp, synthetic construct
  source 1..58: mol_type = other DNA
ctacactctttccctacacgacgctcttccgatctgtccgccggcattcctgctgaac

SEQ ID NO: 628 - DNA, 58 bp, synthetic construct
  source 1..58: mol_type = other DNA
ctacactctttccctacacgacgctcttccgatctacttgacggcattcctgctgaac

SEQ ID NO: 629 - DNA, 58 bp, synthetic construct
  source 1..58: mol_type = other DNA
ctacactctttccctacacgacgctcttccgatctcgtacgcggcattcctgctgaac

SEQ ID NO: 630 - DNA, 58 bp, synthetic construct
  source 1..58: mol_type = other DNA
ctacactctttccctacacgacgctcttccgatctatgtcacggcattcctgctgaac

SEQ ID NO: 631 - DNA, 58 bp, synthetic construct
  source 1..58: mol_type = other DNA
ctacactctttccctacacgacgctcttccgatctgtgaaacggcattcctgctgaac

SEQ ID NO: 632 - DNA, 58 bp, synthetic construct
  source 1..58: mol_type = other DNA
ctacactctttccctacacgacgctcttccgatctgtggcccggcattcctgctgaac

SEQ ID NO: 633 - DNA, 58 bp, synthetic construct
  source 1..58: mol_type = other DNA
ctacactctttccctacacgacgctcttccgatctgtttcgcggcattcctgctgaac

SEQ ID NO: 634 - DNA, 58 bp, synthetic construct
  source 1..58: mol_type = other DNA
ctacactctttccctacacgacgctcttccgatctactgatcggcattcctgctgaac

SEQ ID NO: 635 - DNA, 58 bp, synthetic construct
  source 1..58: mol_type = other DNA
ctacactctttccctacacgacgctcttccgatctgtagagcggcattcctgctgaac

SEQ ID NO: 636 - DNA, 49 bp, synthetic construct
  source 1..49: mol_type = other DNA
caagcagaagacggcatacgagctcttccgatctcggcgacgttgggtc

SEQ ID NO: 637 - DNA, 43 bp, synthetic construct
  source 1..43: mol_type = other DNA
aatgatacggcgaccaccgagatctacactctttccctacacg

SEQ ID NO: 638 - DNA, 18 bp, synthetic construct
  source 1..18: mol_type = other DNA
caagcagaagacggcata

SEQ ID NO: 639 - DNA, 19 bp, synthetic construct
  source 1..19: mol_type = other DNA
gccaaagcccgagagagtg

SEQ ID NO: 640 - DNA, 20 bp, synthetic construct
  source 1..20: mol_type = other DNA
cctcacacaacagcttcatg

SEQ ID NO: 641 - DNA, 22 bp, synthetic construct
  source 1..22: mol_type = other DNA
catcaccaacccacagccaagg

SEQ ID NO: 642 - DNA, 25 bp, synthetic construct
  source 1..25: mol_type = other DNA
ccagcacaacttactcgcacttgac

SEQ ID NO: 643 - DNA, 20 bp, synthetic construct
  source 1..20: mol_type = other DNA
agtccaaggaatgcagtagg

SEQ ID NO: 644 - DNA, 20 bp, synthetic construct
  source 1..20: mol_type = other DNA
ggcacagttcctgtatcagt

SEQ ID NO: 645 - DNA, 22 bp, synthetic construct
  source 1..22: mol_type = other DNA
gccctacatctgctctccctcc

SEQ ID NO: 646 - DNA, 20 bp, synthetic construct
  source 1..20: mol_type = other DNA
gggccgggaaagagttgctg

SEQ ID NO: 647 - DNA, 23 bp, synthetic construct
  source 1..23: mol_type = other DNA
gcgacataggaccttctcctccc

SEQ ID NO: 648 - DNA, 22 bp, synthetic construct
  source 1..22: mol_type = other DNA
ggagggagagcagatgtagggc

SEQ ID NO: 649 - DNA, 53 bp, synthetic construct
  source 1..53: mol_type = other DNA
acactctttccctacacgacgctcttccgatctattgagtcccccgccttcag

SEQ ID NO: 650 - DNA, 54 bp, synthetic construct
  source 1..54: mol_type = other DNA
gtgactggagttcagacgtgtgctcttccgatctatgaagcactgtgggtacga

SEQ ID NO: 651 - DNA, 59 bp, synthetic construct
  source 1..59: mol_type = other DNA
acactctttccctacacgacgctcttccgatctcagttctctggtgaagaagttgaagc

SEQ ID NO: 652 - DNA, 57 bp, synthetic construct
  source 1..57: mol_type = other DNA
acactctttccctacacgacgctcttccgatctgttctctggtgaagaagttgaagc

SEQ ID NO: 653 - DNA, 59 bp, synthetic construct
  source 1..59: mol_type = other DNA
gtgactggagttcagacgtgtgctcttccgatctggaatttcatatgcagaataaatgg

SEQ ID NO: 654 - DNA, 62 bp, synthetic construct
  source 1..62: mol_type = other DNA
gtgactggagttcagacgtgtgctcttccgatctcctggaatttcatatgcagaataaatgg

SEQ ID NO: 655 - DNA, 53 bp, synthetic construct
  source 1..53: mol_type = other DNA
acactctttccctacacgacgctcttccgatctttggtcaggttggctgctgg

SEQ ID NO: 656 - DNA, 55 bp, synthetic construct
  source 1..55: mol_type = other DNA
acactctttccctacacgacgctcttccgatctcgttggtcaggttggctgctgg

SEQ ID NO: 657 - DNA, 56 bp, synthetic construct
  source 1..56: mol_type = other DNA
gtgactggagttcagacgtgtgctcttccgatctctaacactcctcaaacggtccc

SEQ ID NO: 658 - DNA, 54 bp, synthetic construct
  source 1..54: mol_type = other DNA
gtgactggagttcagacgtgtgctcttccgatctaacactcctcaaacggtccc

SEQ ID NO: 659 - DNA, 58 bp, synthetic construct
  source 1..58: mol_type = other DNA
acactctttccctacacgacgctcttccgatctgccgatacctgcgccacatccatcg

SEQ ID NO: 660 - DNA, 55 bp, synthetic construct
  source 1..55: mol_type = other DNA
acactctttccctacacgacgctcttccgatctactacctgcgccacatccatcg

SEQ ID NO: 661 - DNA, 54 bp, synthetic construct
  source 1..54: mol_type = other DNA
gtgactggagttcagacgtgtgctcttccgatctaaagccgccctcttgcctcc

SEQ ID NO: 662 - DNA, 60 bp, synthetic construct
  source 1..60: mol_type = other DNA
acactctttccctacacgacgctcttccgatcttgactttcgaccaatagcattgcagag

SEQ ID NO: 663 - DNA, 59 bp, synthetic construct
  source 1..59: mol_type = other DNA
acactctttccctacacgacgctcttccgatctgactttcgaccaatagcattgcagag

SEQ ID NO: 664 - DNA, 59 bp, synthetic construct
  source 1..59: mol_type = other DNA
gtgactggagttcagacgtgtgctcttccgatctctcctaaggccctacttccgctttc

SEQ ID NO: 665 - DNA, 59 bp, synthetic construct
  source 1..59: mol_type = other DNA
gtgactggagttcagacgtgtgctcttccgatcttgactaaggccctacttccgctttc

SEQ ID NO: 666 - DNA, 54 bp, synthetic construct
  source 1..54: mol_type = other DNA
acactctttccctacacgacgctcttccgatctcctggatcgcttttccgagct

SEQ ID NO: 667 - DNA, 54 bp, synthetic construct
  source 1..54: mol_type = other DNA
gtgactggagttcagacgtgtgctcttccgatctaggtagcgcgcccactgcaa

SEQ ID NO: 668 - DNA, 56 bp, synthetic construct
  source 1..56: mol_type = other DNA
acactctttccctacacgacgctcttccgatctgcaatgcgtctttcaatagccgc

SEQ ID NO: 669 - DNA, 58 bp, synthetic construct
  source 1..58: mol_type = other DNA
gtgactggagttcagacgtgtgctcttccgatcttaaaatgtgcaggatgacaagatg

SEQ ID NO: 670 - DNA, 55 bp, synthetic construct
  source 1..55: mol_type = other DNA
acactctttccctacacgacgctcttccgatctaggtcctggtggtacaagcact

SEQ ID NO: 671 - DNA, 60 bp, synthetic construct
  source 1..60: mol_type = other DNA
gtgactggagttcagacgtgtgctcttccgatcttccactctttaaaatatctgtattcc

SEQ ID NO: 672 - DNA, 53 bp, synthetic construct
  source 1..53: mol_type = other DNA
acactctttccctacacgacgctcttccgatctgtttccctcactcctgctcg

SEQ ID NO: 673 - DNA, 54 bp, synthetic construct
  source 1..54: mol_type = other DNA
gtgactggagttcagacgtgtgctcttccgatctctcctcaaacggtccccaga

SEQ ID NO: 674 - DNA, 54 bp, synthetic construct
  source 1..54: mol_type = other DNA
acactctttccctacacgacgctcttccgatcttgtacatgtgggggcagttgc

SEQ ID NO: 675 - DNA, 55 bp, synthetic construct
  source 1..55: mol_type = other DNA
gtgactggagttcagacgtgtgctcttccgatctacgtgcaactcactcaatcct

SEQ ID NO: 676 - DNA, 53 bp, synthetic construct
  source 1..53: mol_type = other DNA
acactctttccctacacgacgctcttccgatctgtacatgtgggggcagttgc

SEQ ID NO: 677 - DNA, 56 bp, synthetic construct
  source 1..56: mol_type = other DNA
gtgactggagttcagacgtgtgctcttccgatctcacgtgcaactcactcaatcct

SEQ ID NO: 678 - DNA, 23 bp, synthetic construct
  source 1..23: mol_type = other DNA
agcaggcacctgcctcagctgct

SEQ ID NO: 679 - DNA, 23 bp, synthetic construct
  source 1..23: mol_type = other DNA
aggcgggtcacctacccacgttc

SEQ ID NO: 680 - DNA, 23 bp, synthetic construct
  source 1..23: mol_type = other DNA
aggcgggtcacctacccacgttc

SEQ ID NO: 681 - DNA, 23 bp, synthetic construct
  source 1..23: mol_type = other DNA
agcaggcacctgcctcagctgct

SEQ ID NO: 682 - DNA, 23 bp, synthetic construct
  source 1..23: mol_type = other DNA
agcaggcacctgcctcagctgct

SEQ ID NO: 683 - DNA, 23 bp, synthetic construct
  source 1..23: mol_type = other DNA
aggcgggtcacctacccacgttc

SEQ ID NO: 684 - DNA, 23 bp, synthetic construct
  source 1..23: mol_type = other DNA
tggtgaagaagttgaagctgtca

SEQ ID NO: 685 - DNA, 23 bp, synthetic construct
  source 1..23: mol_type = other DNA
catcttgtcatcctgcacatttt

SEQ ID NO: 686 - DNA, 23 bp, synthetic construct
  source 1..23: mol_type = other DNA
tggtgaagaagttgaagctgtca

SEQ ID NO: 687 - DNA, 23 bp, synthetic construct
  source 1..23: mol_type = other DNA
catcttgtcatcctgcacatttt

SEQ ID NO: 688 - DNA, 23 bp, synthetic construct
  source 1..23: mol_type = other DNA
tggtgaagaagttgaagctgtca

SEQ ID NO: 689 - DNA, 23 bp, synthetic construct
  source 1..23: mol_type = other DNA
catcttgtcatcctgcacatttt

SEQ ID NO: 690 - DNA, 23 bp, synthetic construct
  source 1..23: mol_type = other DNA
aagcactacctacgtcagcacct

SEQ ID NO: 691 - DNA, 23 bp, synthetic construct
  source 1..23: mol_type = other DNA
aagcactacctacgtcagcacct

SEQ ID NO: 692 - DNA, 23 bp, synthetic construct
  source 1..23: mol_type = other DNA
aagcactacctacgtcagcacct

SEQ ID NO: 693 - RNA, 44 nt, synthetic construct
  source 1..44: mol_type = other RNA
taaatttctactattgtagatagcaggcacctgcctcagctgct

SEQ ID NO: 694 - RNA, 44 nt, synthetic construct
  source 1..44: mol_type = other RNA
taaatttctactattgtagataggcgggtcacctacccacgttc

SEQ ID NO: 695 - RNA, 44 nt, synthetic construct; identical to SEQ ID NO: 694
  source 1..44: mol_type = other RNA

SEQ ID NO: 696 - RNA, 44 nt, synthetic construct; identical to SEQ ID NO: 693
  source 1..44: mol_type = other RNA

SEQ ID NO: 697 - RNA, 44 nt, synthetic construct
  source 1..44: mol_type = other RNA
aaaatttctgctattgcagatagcaggcacctgcctcagctgct

SEQ ID NO: 698 - RNA, 44 nt, synthetic construct
  source 1..44: mol_type = other RNA
aaaatttctgctattgcagataggcgggtcacctacccacgttc

SEQ ID NO: 699 - RNA, 44 nt, synthetic construct
  source 1..44: mol_type = other RNA
taaatttctactattgtagattggtgaagaagttgaagctgtca

SEQ ID NO: 700 - RNA, 44 nt, synthetic construct
  source 1..44: mol_type = other RNA
taaatttctactattgtagatcatcttgtcatcctgcacatttt

SEQ ID NO: 701 - RNA, 44 nt, synthetic construct; identical to SEQ ID NO: 699
  source 1..44: mol_type = other RNA

SEQ ID NO: 702 - RNA, 44 nt, synthetic construct; identical to SEQ ID NO: 700
  source 1..44: mol_type = other RNA

SEQ ID NO: 703 - RNA, 44 nt, synthetic construct
  source 1..44: mol_type = other RNA
aaaatttctgctattgcagattggtgaagaagttgaagctgtca

SEQ ID NO: 704 - RNA, 44 nt, synthetic construct
  source 1..44: mol_type = other RNA
aaaatttctgctattgcagatcatcttgtcatcctgcacatttt

SEQ ID NO: 705 - RNA, 44 nt, synthetic construct
  source 1..44: mol_type = other RNA
taaatttctactattgtagataagcactacctacgtcagcacct

SEQ ID NO: 706 - RNA, 44 nt, synthetic construct; identical to SEQ ID NO: 705
  source 1..44: mol_type = other RNA

SEQ ID NO: 707 - RNA, 44 nt, synthetic construct
  source 1..44: mol_type = other RNA
aaaatttctgctattgcagataagcactacctacgtcagcacct

SEQ ID NO: 708 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatagcaggcacctgcctcagctgctggccggcatggtcccagcctcctcgctggcgccggctgggcaacatgcttcggcatggcgaatgggac

SEQ ID NO: 709 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagataggcgggtcacctacccacgttcggccggcatggtcccagcctcctcgctggcgccggctgggcaacatgcttcggcatggcgaatgggac

SEQ ID NO: 710 - DNA, 376 bp, synthetic construct; identical to SEQ ID NO: 709
  source 1..376: mol_type = other DNA

SEQ ID NO: 711 - DNA, 376 bp, synthetic construct; identical to SEQ ID NO: 708
  source 1..376: mol_type = other DNA

SEQ ID NO: 712 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatagcaggcacctgcctcagctgctggccggcatggtcccagcctcctcgctggcgccggctgggcaacatgcttcggcatggcgaatgggac

SEQ ID NO: 713 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagataggcgggtcacctacccacgttcggccggcatggtcccagcctcctcgctggcgccggctgggcaacatgcttcggcatggcgaatgggac

SEQ ID NO: 714 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagattggtgaagaagttgaagctgtcaggccggcatggtcccagcctcctcgctggcgccggctgggcaacatgcttcggcatggcgaatgggac

SEQ ID NO: 715 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatcatcttgtcatcctgcacattttggccggcatggtcccagcctcctcgctggcgccggctgggcaacatgcttcggcatggcgaatgggac

SEQ ID NO: 716 - DNA, 376 bp, synthetic construct; identical to SEQ ID NO: 714
  source 1..376: mol_type = other DNA

SEQ ID NO: 717 - DNA, 376 bp, synthetic construct; identical to SEQ ID NO: 715
  source 1..376: mol_type = other DNA

SEQ ID NO: 718 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagattggtgaagaagttgaagctgtcaggccggcatggtcccagcctcctcgctggcgccggctgggcaacatgcttcggcatggcgaatgggac

SEQ ID NO: 719 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatcatcttgtcatcctgcacattttggccggcatggtcccagcctcctcgctggcgccggctgggcaacatgcttcggcatggcgaatgggac

SEQ ID NO: 720 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagataagcactacctacgtcagcacctggccggcatggtcccagcctcctcgctggcgccggctgggcaacatgcttcggcatggcgaatgggac

SEQ ID NO: 721 - DNA, 376 bp, synthetic construct; identical to SEQ ID NO: 720
  source 1..376: mol_type = other DNA

SEQ ID NO: 722 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagataagcactacctacgtcagcacctggccggcatggtcccagcctcctcgctggcgccggctgggcaacatgcttcggcatggcgaatgggac

SEQ ID NO: 723 - RNA, 44 nt, synthetic construct
  source 1..44: mol_type = other RNA
taatttctactaagtgtagataagctagtctagtgcaagctaac

SEQ ID NO: 724 - RNA, 44 nt, synthetic construct
  source 1..44: mol_type = other RNA
tgaatttctactgttgtagataagctagtctagtgcaagctaac

SEQ ID NO: 725 - RNA, 44 nt, synthetic construct
  source 1..44: mol_type = other RNA
ataatttctactgttgtagataagctagtctagtgcaagctaac

SEQ ID NO: 726 - RNA, 44 nt, synthetic construct
  source 1..44: mol_type = other RNA
taaatttctactattgtagataagctagtctagtgcaagctaac

SEQ ID NO: 727 - RNA, 42 nt, synthetic construct
  source 1..42: mol_type = other RNA
taatttctactaagtgtagatactgacagcgtgaacaggtag

SEQ ID NO: 728 - RNA, 42 nt, synthetic construct
  source 1..42: mol_type = other RNA
tgaatttctactgttgtagatactgacagcgtgaacaggtag

SEQ ID NO: 729 - RNA, 42 nt, synthetic construct
  source 1..42: mol_type = other RNA
ataatttctactgttgtagatactgacagcgtgaacaggtag

SEQ ID NO: 730 - RNA, 42 nt, synthetic construct
  source 1..42: mol_type = other RNA
taaatttctactattgtagatactgacagcgtgaacaggtag

SEQ ID NO: 731 - RNA, 44 nt, synthetic construct
  source 1..44: mol_type = other RNA
taatttctactaagtgtagatccttgtcaaggctattggtcaag

SEQ ID NO: 732 - RNA, 44 nt, synthetic construct
  source 1..44: mol_type = other RNA
tgaatttctactgttgtagatccttgtcaaggctattggtcaag

SEQ ID NO: 733 - RNA, 44 nt, synthetic construct
  source 1..44: mol_type = other RNA
ataatttctactgttgtagatccttgtcaaggctattggtcaag

SEQ ID NO: 734 - RNA, 44 nt, synthetic construct
  source 1..44: mol_type = other RNA
taaatttctactattgtagatccttgtcaaggctattggtcaag

SEQ ID NO: 735 - RNA, 44 nt, synthetic construct
  source 1..44: mol_type = other RNA
taatttctactaagtgtagatgcagagaagtggatcagtctctg

SEQ ID NO: 736 - RNA, 44 nt, synthetic construct
  source 1..44: mol_type = other RNA
tgaatttctactgttgtagatgcagagaagtggatcagtctctg

SEQ ID NO: 737 - RNA, 44 nt, synthetic construct
  source 1..44: mol_type = other RNA
ataatttctactgttgtagatgcagagaagtggatcagtctctg

SEQ ID NO: 738 - RNA, 44 nt, synthetic construct
  source 1..44: mol_type = other RNA
taaatttctactattgtagatgcagagaagtggatcagtctctg

SEQ ID NO: 739 - RNA, 44 nt, synthetic construct
  source 1..44: mol_type = other RNA
taatttctactaagtgtagataccatcagaggacacttggattc

SEQ ID NO: 740 - RNA, 44 nt, synthetic construct
  source 1..44: mol_type = other RNA
tgaatttctactgttgtagataccatcagaggacacttggattc

SEQ ID NO: 741 - RNA, 44 nt, synthetic construct
  source 1..44: mol_type = other RNA
ataatttctactgttgtagataccatcagaggacacttggattc

SEQ ID NO: 742 - RNA, 44 nt, synthetic construct
  source 1..44: mol_type = other RNA
taaatttctactattgtagataccatcagaggacacttggattc

SEQ ID NO: 743 - RNA, 99 nt, synthetic construct
  source 1..99: mol_type = other RNA
  ncRNA 1..99: ncRNA_class = sgRNA
aaaggctgctgatgacacctgttttagagctagaaatagcaagttaaaataaggctagtccgttatcaacttgaaaaagtggcaccgagtcggtgcttt

SEQ ID NO: 744 - RNA, 99 nt, synthetic construct
  source 1..99: mol_type = other RNA
  ncRNA 1..99: ncRNA_class = sgRNA
  modified_base order(2,8,9,12..15,17): mod_base = OTHER; note = Thymine
ctaacagttgcttttatcacgttttagagctagaaatagcaagttaaaataaggctagtccgttatcaacttgaaaaagtggcaccgagtcggtgcttt

SEQ ID NO: 745 - RNA, 99 nt, synthetic construct
  source 1..99: mol_type = other RNA
  ncRNA 1..99: ncRNA_class = sgRNA
  modified_base order(2,3,5,12,14,15,18): mod_base = OTHER; note = Thymine
cttgtcaaggctattggtcagttttagagctagaaatagcaagttaaaataaggctagtccgttatcaacttgaaaaagtggcaccgagtcggtgcttt

SEQ ID NO: 746 - RNA, 99 nt, synthetic construct
  source 1..99: mol_type = other RNA
  ncRNA 1..99: ncRNA_class = sgRNA
  modified_base order(6,13,15,19,20): mod_base = OTHER; note = Thymine
caggatcggggctgtcgcttgttttagagctagaaatagcaagttaaaataaggctagtccgttatcaacttgaaaaagtggcaccgagtcggtgcttt

SEQ ID NO: 747 - RNA, 99 nt, synthetic construct
  source 1..99: mol_type = other RNA
  ncRNA 1..99: ncRNA_class = sgRNA
  modified_base order(5,8,9,12,17,19,20): mod_base = OTHER; note = Thymine
ggcctcattgatgacatcttgttttagagctagaaatagcaagttaaaataaggctagtccgttatcaacttgaaaaagtggcaccgagtcggtgcttt

SEQ ID NO: 748 - DNA, 20 bp, synthetic construct
  source 1..20: mol_type = other DNA
aggaaggcagctagacagga

SEQ ID NO: 749 - DNA, 20 bp, synthetic construct
  source 1..20: mol_type = other DNA
ggacagcccgacagatgaaa

SEQ ID NO: 750 - DNA, 20 bp, synthetic construct
  source 1..20: mol_type = other DNA
gagaggcacagccctctcta

SEQ ID NO: 751 - DNA, 20 bp, synthetic construct
  source 1..20: mol_type = other DNA
cagtggcaggcagtccacgt

SEQ ID NO: 752 - DNA, 27 bp, synthetic construct
  source 1..27: mol_type = other DNA
ctctatgatgggagaaggaaactagct

SEQ ID NO: 753 - DNA, 25 bp, synthetic construct
  source 1..25: mol_type = other DNA
ggacaggttgccaaagctgtcaaag

SEQ ID NO: 754 - DNA, 20 bp, synthetic construct
  source 1..20: mol_type = other DNA
gaaggcatcttggaggaggg

SEQ ID NO: 755 - DNA, 20 bp, synthetic construct
  source 1..20: mol_type = other DNA
ccctttcagagccccattct

SEQ ID NO: 756 - DNA, 26 bp, synthetic construct
  source 1..26: mol_type = other DNA
gggatcagtgtgtaattcttgtttcg

SEQ ID NO: 757 - DNA, 25 bp, synthetic construct
  source 1..25: mol_type = other DNA
gtgttctgtgacccaaaagggttgc

SEQ ID NO: 758 - RNA, 41 nt, synthetic construct
  source 1..41: mol_type = other RNA
taatttctactaagtgtagattgtcctcttcctctttagcg

SEQ ID NO: 759 - RNA, 41 nt, synthetic construct
  source 1..41: mol_type = other RNA
ggaatttctactgttgtagattgtcctcttcctctttagcg

SEQ ID NO: 760 - RNA, 41 nt, synthetic construct
  source 1..41: mol_type = other RNA
agaatttctactgttgtagattgtcctcttcctctttagcg

SEQ ID NO: 761 - RNA, 41 nt, synthetic construct
  source 1..41: mol_type = other RNA
aaaatttctactcttgtagattgtcctcttcctctttagcg

SEQ ID NO: 762 - RNA, 41 nt, synthetic construct
  source 1..41: mol_type = other RNA
aaaatttctactattgtagattgtcctcttcctctttagcg

SEQ ID NO: 763 - RNA, 41 nt, synthetic construct; identical to SEQ ID NO: 761
  source 1..41: mol_type = other RNA

SEQ ID NO: 764 - RNA, 41 nt, synthetic construct
  source 1..41: mol_type = other RNA
tgaatttctactgttgtagattgtcctcttcctctttagcg

SEQ ID NO: 765 - RNA, 41 nt, synthetic construct
  source 1..41: mol_type = other RNA
taaatttctactgttgtagattgtcctcttcctctttagcg

SEQ ID NO: 766 - RNA, 41 nt, synthetic construct; identical to SEQ ID NO: 762
  source 1..41: mol_type = other RNA

SEQ ID NO: 767 - RNA, 41 nt, synthetic construct
  source 1..41: mol_type = other RNA
aaaatttctgctattgcagattgtcctcttcctctttagcg

SEQ ID NO: 768 - RNA, 41 nt, synthetic construct
  source 1..41: mol_type = other RNA
taaatttctactattgtagattgtcctcttcctctttagcg

SEQ ID NO: 769 - RNA, 41 nt, synthetic construct
  source 1..41: mol_type = other RNA
ataatttctactatcgtagattgtcctcttcctctttagcg

SEQ ID NO: 770 - RNA, 41 nt, synthetic construct; identical to SEQ ID NO: 765
  source 1..41: mol_type = other RNA

SEQ ID NO: 771 - RNA, 41 nt, synthetic construct
  source 1..41: mol_type = other RNA
ttaatttctactattgtagattgtcctcttcctctttagcg

SEQ ID NO: 772 - RNA, 41 nt, synthetic construct
  source 1..41: mol_type = other RNA
ataatttctactattgtagattgtcctcttcctctttagcg

SEQ ID NO: 773 - RNA, 41 nt, synthetic construct
  source 1..41: mol_type = other RNA
ataatttctactgttgtagattgtcctcttcctctttagcg

SEQ ID NO: 774 - RNA, 41 nt, synthetic construct
  source 1..41: mol_type = other RNA
ttaatttctactctcgtagattgtcctcttcctctttagcg

SEQ ID NO: 775 - RNA, 41 nt, synthetic construct; identical to SEQ ID NO: 769
  source 1..41: mol_type = other RNA

SEQ ID NO: 776 - RNA, 41 nt, synthetic construct; identical to SEQ ID NO: 765
  source 1..41: mol_type = other RNA

SEQ ID NO: 777 - RNA, 41 nt, synthetic construct; identical to SEQ ID NO: 768
  source 1..41: mol_type = other RNA

SEQ ID NO: 778 - RNA, 41 nt, synthetic construct; identical to SEQ ID NO: 760
  source 1..41: mol_type = other RNA

SEQ ID NO: 779 - RNA, 41 nt, synthetic construct; identical to SEQ ID NO: 772
  source 1..41: mol_type = other RNA

SEQ ID NO: 780 - RNA, 41 nt, synthetic construct; identical to SEQ ID NO: 772
  source 1..41: mol_type = other RNA

SEQ ID NO: 781 - RNA, 41 nt, synthetic construct; identical to SEQ ID NO: 762
  source 1..41: mol_type = other RNA

SEQ ID NO: 782 - RNA, 41 nt, synthetic construct
  source 1..41: mol_type = other RNA
gaaatttctactatcgtagattgtcctcttcctctttagcg

SEQ ID NO: 783 - RNA, 41 nt, synthetic construct; identical to SEQ ID NO: 772
  source 1..41: mol_type = other RNA

SEQ ID NO: 784 - RNA, 41 nt, synthetic construct; identical to SEQ ID NO: 768
  source 1..41: mol_type = other RNA

SEQ ID NO: 785 - RNA, 41 nt, synthetic construct
  source 1..41: mol_type = other RNA
tcaatttctactgttgtagattgtcctcttcctctttagcg

SEQ ID NO: 786 - RNA, 41 nt, synthetic construct; identical to SEQ ID NO: 762
  source 1..41: mol_type = other RNA

SEQ ID NO: 787 - RNA, 41 nt, synthetic construct; identical to SEQ ID NO: 768
  source 1..41: mol_type = other RNA

SEQ ID NO: 788 - RNA, 41 nt, synthetic construct; identical to SEQ ID NO: 773
  source 1..41: mol_type = other RNA

SEQ ID NO: 789 - RNA, 41 nt, synthetic construct
  source 1..41: mol_type = other RNA
agaatttctacttatgtagattgtcctcttcctctttagcg

SEQ ID NO: 790 - RNA, 41 nt, synthetic construct
  source 1..41: mol_type = other RNA
tcaatttctacttttgtagattgtcctcttcctctttagcg

SEQ ID NO: 791 - RNA, 41 nt, synthetic construct; identical to SEQ ID NO: 773
  source 1..41: mol_type = other RNA

SEQ ID NO: 792 - RNA, 41 nt, synthetic construct; identical to SEQ ID NO: 767
  source 1..41: mol_type = other RNA

SEQ ID NO: 793 - DNA, 23 bp, synthetic construct
  source 1..23: mol_type = other DNA
cctcactcctgctcggtgaattt

SEQ ID NO: 794 - DNA, 23 bp, synthetic construct
  source 1..23: mol_type = other DNA
cctcactcctgctcggtgaattt

SEQ ID NO: 795 - DNA, 23 bp, synthetic construct
  source 1..23: mol_type = other DNA
cctcactcctgctcggtgaattt

SEQ ID NO: 796 - DNA, 23 bp, synthetic construct
  source 1..23: mol_type = other DNA
cctcactcctgctcggtgaattt

SEQ ID NO: 797 - DNA, 23 bp, synthetic construct
  source 1..23: mol_type = other DNA
cctcactcctgctcggtgaattt

SEQ ID NO: 798 - DNA, 23 bp, synthetic construct
  source 1..23: mol_type = other DNA
cctcactcctgctcggtgaattt

SEQ ID NO: 799 - DNA, 23 bp, synthetic construct
  source 1..23: mol_type = other DNA
cctcactcctgctcggtgaattt

SEQ ID NO: 800 - DNA, 23 bp, synthetic construct
  source 1..23: mol_type = other DNA
cctcactcctgctcggtgaattt

SEQ ID NO: 801 - DNA, 23 bp, synthetic construct
  source 1..23: mol_type = other DNA
cctcactcctgctcggtgaattt

SEQ ID NO: 802 - DNA, 23 bp, synthetic construct
  source 1..23: mol_type = other DNA
tgggactcaggcgggtcacctac

SEQ ID NO: 803 - DNA, 23 bp, synthetic construct
  source 1..23: mol_type = other DNA
agcaggcacctgcctcagctgct

SEQ ID NO: 804 - DNA, 23 bp, synthetic construct
  source 1..23: mol_type = other DNA
aggcgggtcacctacccacgttc

SEQ ID NO: 805 - DNA, 23 bp, synthetic construct
  source 1..23: mol_type = other DNA
actcctgctcggtgaatttggct

SEQ ID NO: 806 - DNA, 23 bp, synthetic construct
  source 1..23: mol_type = other DNA
cctcactcctgctcggtgaattt

SEQ ID NO: 807 - DNA, 23 bp, synthetic construct
  source 1..23: mol_type = other DNA
cctcactcctgctcggtgaattt

SEQ ID NO: 808 - DNA, 23 bp, synthetic construct
  source 1..23: mol_type = other DNA
cctcactcctgctcggtgaattt

SEQ ID NO: 809 - DNA, 23 bp, synthetic construct
  source 1..23: mol_type = other DNA
cctcactcctgctcggtgaattt

SEQ ID NO: 810 - DNA, 23 bp, synthetic construct
  source 1..23: mol_type = other DNA
cctcactcctgctcggtgaattt

SEQ ID NO: 811 - DNA, 23 bp, synthetic construct
  source 1..23: mol_type = other DNA
cctcactcctgctcggtgaattt

SEQ ID NO: 812 - DNA, 23 bp, synthetic construct
  source 1..23: mol_type = other DNA
ggctctgggactcaggcgggtca

SEQ ID NO: 813 - DNA, 23 bp, synthetic construct
  source 1..23: mol_type = other DNA
gctcagcaggcacctgcctcagc

SEQ ID NO: 814 - DNA, 23 bp, synthetic construct
  source 1..23: mol_type = other DNA
cctcactcctgctcggtgaattt

SEQ ID NO: 815 - DNA, 23 bp, synthetic construct
  source 1..23: mol_type = other DNA
cctcactcctgctcggtgaattt

SEQ ID NO: 816 - DNA, 23 bp, synthetic construct
  source 1..23: mol_type = other DNA
cctcactcctgctcggtgaattt

SEQ ID NO: 817 - DNA, 23 bp, synthetic construct
  source 1..23: mol_type = other DNA
cctcactcctgctcggtgaattt

SEQ ID NO: 818 - DNA, 23 bp, synthetic construct
  source 1..23: mol_type = other DNA
cctcactcctgctcggtgaattt

SEQ ID NO: 819 - DNA, 23 bp, synthetic construct
  source 1..23: mol_type = other DNA
cctcactcctgctcggtgaattt

SEQ ID NO: 820 - DNA, 23 bp, synthetic construct
  source 1..23: mol_type = other DNA
cctcactcctgctcggtgaattt

SEQ ID NO: 821 - DNA, 23 bp, synthetic construct
  source 1..23: mol_type = other DNA
ctgatggtccatgtctgttactc

SEQ ID NO: 822 - DNA, 23 bp, synthetic construct
  source 1..23: mol_type = other DNA
accgagcaggagtgagggaaacg

SEQ ID NO: 823 - DNA, 23 bp, synthetic construct
  source 1..23: mol_type = other DNA
cctcactcctgctcggtgaattt

SEQ ID NO: 824 - DNA, 23 bp, synthetic construct
  source 1..23: mol_type = other DNA
cctcactcctgctcggtgaattt

SEQ ID NO: 825 - DNA, 23 bp, synthetic construct
  source 1..23: mol_type = other DNA
cctcactcctgctcggtgaattt

SEQ ID NO: 826 - DNA, 23 bp, synthetic construct
  source 1..23: mol_type = other DNA
tgggactcaggcgggtcacctac

SEQ ID NO: 827 - DNA, 23 bp, synthetic construct
  source 1..23: mol_type = other DNA
aggcgggtcacctacccacgttc

SEQ ID NO: 828 - DNA, 23 bp, synthetic construct
  source 1..23: mol_type = other DNA
agcaggcacctgcctcagctgct

SEQ ID NO: 829 - DNA, 23 bp, synthetic construct
  source 1..23: mol_type = other DNA
actcctgctcggtgaatttggct

SEQ ID NO: 830 - DNA, 23 bp, synthetic construct
  source 1..23: mol_type = other DNA
cctcactcctgctcggtgaattt

SEQ ID NO: 831 - DNA, 23 bp, synthetic construct
  source 1..23: mol_type = other DNA
cctcactcctgctcggtgaattt

SEQ ID NO: 832 - DNA, 23 bp, synthetic construct
  source 1..23: mol_type = other DNA
actcctgctcggtgaatttggct

SEQ ID NO: 833 - DNA, 23 bp, synthetic construct
  source 1..23: mol_type = other DNA
agcaggcacctgcctcagctgct

SEQ ID NO: 834 - DNA, 23 bp, synthetic construct
  source 1..23: mol_type = other DNA
aggcgggtcacctacccacgttc

SEQ ID NO: 835 - DNA, 22 bp, synthetic construct
  source 1..22: mol_type = other DNA
caggaggaagcgatggcttcag

SEQ ID NO: 836 - DNA, 22 bp, synthetic construct
  source 1..22: mol_type = other DNA
caggaggaagcgatggcttcag

SEQ ID NO: 837 - DNA, 22 bp, synthetic construct
  source 1..22: mol_type = other DNA
caggaggaagcgatggcttcag

SEQ ID NO: 838 - DNA, 22 bp, synthetic construct
  source 1..22: mol_type = other DNA
caggaggaagcgatggcttcag

SEQ ID NO: 839 - DNA, 22 bp, synthetic construct
  source 1..22: mol_type = other DNA
caggaggaagcgatggcttcag

SEQ ID NO: 840 - DNA, 22 bp, synthetic construct
  source 1..22: mol_type = other DNA
caggaggaagcgatggcttcag

SEQ ID NO: 841 - DNA, 22 bp, synthetic construct
  source 1..22: mol_type = other DNA
caggaggaagcgatggcttcag

SEQ ID NO: 842 - DNA, 22 bp, synthetic construct
  source 1..22: mol_type = other DNA
caggaggaagcgatggcttcag

SEQ ID NO: 843 - DNA, 22 bp, synthetic construct
  source 1..22: mol_type = other DNA
caggaggaagcgatggcttcag

SEQ ID NO: 844 - DNA, 23 bp, synthetic construct
  source 1..23: mol_type = other DNA
agctttgcctgtaatgaaatggc

SEQ ID NO: 845 - DNA, 23 bp, synthetic construct
  source 1..23: mol_type = other DNA
ggtgcagagatgcctcggtgcct

SEQ ID NO: 846 - DNA, 22 bp, synthetic construct
  source 1..22: mol_type = other DNA
caggaggaagcgatggcttcag

SEQ ID NO: 847 - DNA, 22 bp, synthetic construct
  source 1..22: mol_type = other DNA
caggaggaagcgatggcttcag

SEQ ID NO: 848 - DNA, 22 bp, synthetic construct
  source 1..22: mol_type = other DNA
caggaggaagcgatggcttcag

SEQ ID NO: 849 - DNA, 22 bp, synthetic construct
  source 1..22: mol_type = other DNA
caggaggaagcgatggcttcag

SEQ ID NO: 850 - DNA, 22 bp, synthetic construct
  source 1..22: mol_type = other DNA
caggaggaagcgatggcttcag

SEQ ID NO: 851 - DNA, 22 bp, synthetic construct
  source 1..22: mol_type = other DNA
caggaggaagcgatggcttcag

SEQ ID NO: 852 - DNA, 23 bp, synthetic construct
  source 1..23: mol_type = other DNA
tttttacaaaggtgcatttttta

SEQ ID NO: 853 - DNA, 23 bp, synthetic construct
  source 1..23: mol_type = other DNA
ctcagctttgcctgtaatgaaat

SEQ ID NO: 854 - DNA, 22 bp, synthetic construct
  source 1..22: mol_type = other DNA
caggaggaagcgatggcttcag

SEQ ID NO: 855 - DNA, 22 bp, synthetic construct
  source 1..22: mol_type = other DNA
caggaggaagcgatggcttcag

SEQ ID NO: 856 - DNA, 22 bp, synthetic construct
  source 1..22: mol_type = other DNA
caggaggaagcgatggcttcag

SEQ ID NO: 857 - DNA, 22 bp, synthetic construct
  source 1..22: mol_type = other DNA
caggaggaagcgatggcttcag

SEQ ID NO: 858 - DNA, 22 bp, synthetic construct
  source 1..22: mol_type = other DNA
caggaggaagcgatggcttcag

SEQ ID NO: 859 - DNA, 22 bp, synthetic construct
  source 1..22: mol_type = other DNA
caggaggaagcgatggcttcag

SEQ ID NO: 860 - DNA, 23 bp, synthetic construct
  source 1..23: mol_type = other DNA
agacagcatatttgagtcatttc

SEQ ID NO: 861 - DNA, 23 bp, synthetic construct
  source 1..23: mol_type = other DNA
cttactaatcagatggaagctct

SEQ ID NO: 862 - DNA, 22 bp, synthetic construct
  source 1..22: mol_type = other DNA
caggaggaagcgatggcttcag

SEQ ID NO: 863 - DNA, 22 bp, synthetic construct
  source 1..22: mol_type = other DNA
caggaggaagcgatggcttcag

SEQ ID NO: 864 - DNA, 22 bp, synthetic construct
  source 1..22: mol_type = other DNA
caggaggaagcgatggcttcag

SEQ ID NO: 865 - DNA, 22 bp, synthetic construct
  source 1..22: mol_type = other DNA
caggaggaagcgatggcttcag

SEQ ID NO: 866 - DNA, 22 bp, synthetic construct
  source 1..22: mol_type = other DNA
caggaggaagcgatggcttcag

SEQ ID NO: 867 - DNA, 22 bp, synthetic construct
  source 1..22: mol_type = other DNA
caggaggaagcgatggcttcag

SEQ ID NO: 868 - DNA, 23 bp, synthetic construct
  source 1..23: mol_type = other DNA
agctttgcctgtaatgaaatggc

SEQ ID NO: 869 - DNA, 23 bp, synthetic construct
  source 1..23: mol_type = other DNA
ggtgcagagatgcctcggtgcct

SEQ ID NO: 870 - DNA, 20 bp, synthetic construct
  source 1..20: mol_type = other DNA
ctccatcttgtcatcctgca

SEQ ID NO: 871 - DNA, 20 bp, synthetic construct
  source 1..20: mol_type = other DNA
ctccatcttgtcatcctgca

SEQ ID NO: 872 - DNA, 20 bp, synthetic construct
  source 1..20: mol_type = other DNA
ctccatcttgtcatcctgca

SEQ ID NO: 873 - DNA, 20 bp, synthetic construct
  source 1..20: mol_type = other DNA
ctccatcttgtcatcctgca

SEQ ID NO: 874 - DNA, 20 bp, synthetic construct
  source 1..20: mol_type = other DNA
ctccatcttgtcatcctgca

SEQ ID NO: 875 - DNA, 20 bp, synthetic construct
  source 1..20: mol_type = other DNA
ctccatcttgtcatcctgca

SEQ ID NO: 876 - DNA, 20 bp, synthetic construct
  source 1..20: mol_type = other DNA
ctccatcttgtcatcctgca

SEQ ID NO: 877 - DNA, 20 bp, synthetic construct
  source 1..20: mol_type = other DNA
ctccatcttgtcatcctgca

SEQ ID NO: 878 - DNA, 20 bp, synthetic construct
  source 1..20: mol_type = other DNA
ctccatcttgtcatcctgca

SEQ ID NO: 879 - DNA, 23 bp, synthetic construct
  source 1..23: mol_type = other DNA
tggtgaagaagttgaagctgtca

SEQ ID NO: 880 - DNA, 23 bp, synthetic construct
  source 1..23: mol_type = other DNA
catcttgtcatcctgcacatttt

SEQ ID NO: 881 - DNA, 20 bp, synthetic construct
  source 1..20: mol_type = other DNA
ctccatcttgtcatcctgca

SEQ ID NO: 882 - DNA, 20 bp, synthetic construct
  source 1..20: mol_type = other DNA
ctccatcttgtcatcctgca

SEQ ID NO: 883 - DNA, 20 bp, synthetic construct
  source 1..20: mol_type = other DNA
ctccatcttgtcatcctgca

SEQ ID NO: 884 - DNA, 20 bp, synthetic construct
  source 1..20: mol_type = other DNA
ctccatcttgtcatcctgca

SEQ ID NO: 885 - DNA, 20 bp, synthetic construct
  source 1..20: mol_type = other DNA
ctccatcttgtcatcctgca

SEQ ID NO: 886 - DNA, 20 bp, synthetic construct
  source 1..20: mol_type = other DNA
ctccatcttgtcatcctgca

SEQ ID NO: 887 - DNA, 20 bp, synthetic construct
  source 1..20: mol_type = other DNA
ctccatcttgtcatcctgca

SEQ ID NO: 888 - DNA, 20 bp, synthetic construct
  source 1..20: mol_type = other DNA
ctccatcttgtcatcctgca

SEQ ID NO: 889 - DNA, 20 bp, synthetic construct
  source 1..20: mol_type = other DNA
ctccatcttgtcatcctgca

SEQ ID NO: 890 - DNA, 20 bp, synthetic construct
  source 1..20: mol_type = other DNA
ctccatcttgtcatcctgca

SEQ ID NO: 891 - DNA, 20 bp, synthetic construct
  source 1..20: mol_type = other DNA
ctccatcttgtcatcctgca

SEQ ID NO: 892 - DNA, 20 bp, synthetic construct
  source 1..20: mol_type = other DNA
ctccatcttgtcatcctgca

SEQ ID NO: 893 - DNA, 20 bp, synthetic construct
  source 1..20: mol_type = other DNA
ctccatcttgtcatcctgca

SEQ ID NO: 894 - DNA, 23 bp, synthetic construct
  source 1..23: mol_type = other DNA
tttgccttttcttctgcaatgcg

SEQ ID NO: 895 - DNA, 23 bp, synthetic construct
  source 1..23: mol_type = other DNA
tctggtgaagaagttgaagctgt

SEQ ID NO: 896 - DNA, 20 bp, synthetic construct
  source 1..20: mol_type = other DNA
ctccatcttgtcatcctgca

SEQ ID NO: 897 - DNA, 20 bp, synthetic construct
  source 1..20: mol_type = other DNA
ctccatcttgtcatcctgca

SEQ ID NO: 898 - DNA, 20 bp, synthetic construct
  source 1..20: mol_type = other DNA
ctccatcttgtcatcctgca

SEQ ID NO: 899 - DNA, 20 bp, synthetic construct
  source 1..20: mol_type = other DNA
ctccatcttgtcatcctgca

SEQ ID NO: 900 - DNA, 20 bp, synthetic construct
  source 1..20: mol_type = other DNA
ctccatcttgtcatcctgca

SEQ ID NO: 901 - DNA, 20 bp, synthetic construct
  source 1..20: mol_type = other DNA
ctccatcttgtcatcctgca

SEQ ID NO: 902 - DNA, 20 bp, synthetic construct
  source 1..20: mol_type = other DNA
ctccatcttgtcatcctgca

SEQ ID NO: 903 - DNA, 23 bp, synthetic construct
  source 1..23: mol_type = other DNA
tggtgaagaagttgaagctgtca

SEQ ID NO: 904 - DNA, 23 bp, synthetic construct
  source 1..23: mol_type = other DNA
catcttgtcatcctgcacatttt

SEQ ID NO: 905 - DNA, 23 bp, synthetic construct
  source 1..23: mol_type = other DNA
gtcggcatggccccattcgcacg

SEQ ID NO: 906 - DNA, 23 bp, synthetic construct
  source 1..23: mol_type = other DNA
gtcggcatggccccattcgcacg

SEQ ID NO: 907 - DNA, 23 bp, synthetic construct
  source 1..23: mol_type = other DNA
gtcggcatggccccattcgcacg

SEQ ID NO: 908 - DNA, 23 bp, synthetic construct
  source 1..23: mol_type = other DNA
gtcggcatggccccattcgcacg

SEQ ID NO: 909 - DNA, 23 bp, synthetic construct
  source 1..23: mol_type = other DNA
gtcggcatggccccattcgcacg

SEQ ID NO: 910 - DNA, 23 bp, synthetic construct
  source 1..23: mol_type = other DNA
gtcggcatggccccattcgcacg

SEQ ID NO: 911 - DNA, 23 bp, synthetic construct
  source 1..23: mol_type = other DNA
gtcggcatggccccattcgcacg

SEQ ID NO: 912 - DNA, 23 bp, synthetic construct
  source 1..23: mol_type = other DNA
gtcggcatggccccattcgcacg

SEQ ID NO: 913 - DNA, 23 bp, synthetic construct
  source 1..23: mol_type = other DNA
gtcggcatggccccattcgcacg

SEQ ID NO: 914 - DNA, 23 bp, synthetic construct
  source 1..23: mol_type = other DNA
atggaatcccttctgcagcacct

SEQ ID NO: 915 - DNA, 23 bp, synthetic construct
  source 1..23: mol_type = other DNA
gtcggcatggccccattcgcacg

SEQ ID NO: 916 - DNA, 23 bp, synthetic construct
  source 1..23: mol_type = other DNA
gtcggcatggccccattcgcacg

SEQ ID NO: 917 - DNA, 23 bp, synthetic construct
  source 1..23: mol_type = other DNA
gtcggcatggccccattcgcacg

SEQ ID NO: 918 - DNA, 23 bp, synthetic construct
  source 1..23: mol_type = other DNA
gtcggcatggccccattcgcacg

SEQ ID NO: 919 - DNA, 23 bp, synthetic construct
  source 1..23: mol_type = other DNA
gtcggcatggccccattcgcacg

SEQ ID NO: 920 - DNA, 23 bp, synthetic construct
  source 1..23: mol_type = other DNA
gtcggcatggccccattcgcacg

SEQ ID NO: 921 - DNA, 23 bp, synthetic construct
  source 1..23: mol_type = other DNA
tcctaaaaattacgaaaacgaaa

SEQ ID NO: 922 - DNA, 23 bp, synthetic construct
  source 1..23: mol_type = other DNA
gtcggcatggccccattcgcacg

SEQ ID NO: 923 - DNA, 23 bp, synthetic construct
  source 1..23: mol_type = other DNA
gtcggcatggccccattcgcacg

SEQ ID NO: 924 - DNA, 23 bp, synthetic construct
  source 1..23: mol_type = other DNA
gtcggcatggccccattcgcacg

SEQ ID NO: 925 - DNA, 23 bp, synthetic construct
  source 1..23: mol_type = other DNA
gtcggcatggccccattcgcacg

SEQ ID NO: 926 - DNA, 23 bp, synthetic construct
  source 1..23: mol_type = other DNA
gtcggcatggccccattcgcacg

SEQ ID NO: 927 - DNA, 23 bp, synthetic construct
  source 1..23: mol_type = other DNA
gtcggcatggccccattcgcacg

SEQ ID NO: 928 - DNA, 23 bp, synthetic construct
  source 1..23: mol_type = other DNA
aaataatctgggcttcagttcta

SEQ ID NO: 929 - DNA, 23 bp, synthetic construct
  source 1..23: mol_type = other DNA
gcgaacttccaggccctcggtca

SEQ ID NO: 930 - DNA, 23 bp, synthetic construct
  source 1..23: mol_type = other DNA
gtcggcatggccccattcgcacg

SEQ ID NO: 931 - DNA, 23 bp, synthetic construct
  source 1..23: mol_type = other DNA
gtcggcatggccccattcgcacg

SEQ ID NO: 932 - DNA, 23 bp, synthetic construct
  source 1..23: mol_type = other DNA
gtcggcatggccccattcgcacg

SEQ ID NO: 933 - DNA, 23 bp, synthetic construct
  source 1..23: mol_type = other DNA
tggcgttacttaattttgaaaaa

SEQ ID NO: 934 - DNA, 23 bp, synthetic construct
  source 1..23: mol_type = other DNA
gtcggcatggccccattcgcacg

SEQ ID NO: 935 - DNA, 23 bp, synthetic construct
  source 1..23: mol_type = other DNA
gtcggcatggccccattcgcacg

SEQ ID NO: 936 - DNA, 23 bp, synthetic construct
  source 1..23: mol_type = other DNA
tggcgttacttaattttgaaaaa

SEQ ID NO: 937 - DNA, 22 bp, synthetic construct
  source 1..22: mol_type = other DNA
gcggatgttccaatcagtacgc

SEQ ID NO: 938 - DNA, 22 bp, synthetic construct
  source 1..22: mol_type = other DNA
gcggatgttccaatcagtacgc

SEQ ID NO: 939 - DNA, 22 bp, synthetic construct
  source 1..22: mol_type = other DNA
gcggatgttccaatcagtacgc

SEQ ID NO: 940 - DNA, 22 bp, synthetic construct
  source 1..22: mol_type = other DNA
gcggatgttccaatcagtacgc

SEQ ID NO: 941 - DNA, 22 bp, synthetic construct
  source 1..22: mol_type = other DNA
gcggatgttccaatcagtacgc

SEQ ID NO: 942 - DNA, 22 bp, synthetic construct
  source 1..22: mol_type = other DNA
gcggatgttccaatcagtacgc

SEQ ID NO: 943 - DNA, 22 bp, synthetic construct
  source 1..22: mol_type = other DNA
gcggatgttccaatcagtacgc

SEQ ID NO: 944 - DNA, 22 bp, synthetic construct
  source 1..22: mol_type = other DNA
gcggatgttccaatcagtacgc

SEQ ID NO: 945 - DNA, 22 bp, synthetic construct
  source 1..22: mol_type = other DNA
gcggatgttccaatcagtacgc

SEQ ID NO: 946 - DNA, 23 bp, synthetic construct
  source 1..23: mol_type = other DNA
aagcactacctacgtcagcacct

SEQ ID NO: 947 - DNA, 22 bp, synthetic construct
  source 1..22: mol_type = other DNA
gcggatgttccaatcagtacgc

SEQ ID NO: 948 - DNA, 22 bp, synthetic construct
  source 1..22: mol_type = other DNA
gcggatgttccaatcagtacgc

SEQ ID NO: 949 - DNA, 22 bp, synthetic construct
  source 1..22: mol_type = other DNA
gcggatgttccaatcagtacgc

SEQ ID NO: 950 - DNA, 22 bp, synthetic construct
  source 1..22: mol_type = other DNA
gcggatgttccaatcagtacgc

SEQ ID NO: 951 - DNA, 22 bp, synthetic construct
  source 1..22: mol_type = other DNA
gcggatgttccaatcagtacgc

SEQ ID NO: 952 - DNA, 22 bp, synthetic construct
  source 1..22: mol_type = other DNA
gcggatgttccaatcagtacgc

SEQ ID NO: 953 - DNA, 23 bp, synthetic construct
  source 1..23: mol_type = other DNA
aaaaacctcaacacagattctag

SEQ ID NO: 954 - DNA, 22 bp, synthetic construct
  source 1..22: mol_type = other DNA
gcggatgttccaatcagtacgc

SEQ ID NO: 955 - DNA, 22 bp, synthetic construct
  source 1..22: mol_type = other DNA
gcggatgttccaatcagtacgc

SEQ ID NO: 956 - DNA, 22 bp, synthetic construct
  source 1..22: mol_type = other DNA
gcggatgttccaatcagtacgc

SEQ ID NO: 957 - DNA, 22 bp, synthetic construct
  source 1..22: mol_type = other DNA
gcggatgttccaatcagtacgc

SEQ ID NO: 958 - DNA, 22 bp, synthetic construct
  source 1..22: mol_type = other DNA
gcggatgttccaatcagtacgc

SEQ ID NO: 959 - DNA, 22 bp, synthetic construct
  source 1..22: mol_type = other DNA
gcggatgttccaatcagtacgc

SEQ ID NO: 960 - DNA, 23 bp, synthetic construct
  source 1..23: mol_type = other DNA
ctcacgtcacagtatgtctctgg

SEQ ID NO: 961 - DNA, 22 bp, synthetic construct
  source 1..22: mol_type = other DNA
gcggatgttccaatcagtacgc

SEQ ID NO: 962 - DNA, 22 bp, synthetic construct
  source 1..22: mol_type = other DNA
gcggatgttccaatcagtacgc

SEQ ID NO: 963 - DNA, 22 bp, synthetic construct
  source 1..22: mol_type = other DNA
gcggatgttccaatcagtacgc

SEQ ID NO: 964 - DNA, 22 bp, synthetic construct
  source 1..22: mol_type = other DNA
gcggatgttccaatcagtacgc

SEQ ID NO: 965 - DNA, 23 bp, synthetic construct
  source 1..23: mol_type = other DNA
aagcactacctacgtcagcacct

SEQ ID NO: 966 - DNA, 22 bp, synthetic construct
  source 1..22: mol_type = other DNA
gcggatgttccaatcagtacgc

SEQ ID NO: 967 - DNA, 22 bp, synthetic construct
  source 1..22: mol_type = other DNA
gcggatgttccaatcagtacgc

SEQ ID NO: 968 - DNA, 23 bp, synthetic construct
  source 1..23: mol_type = other DNA
aagcactacctacgtcagcacct

SEQ ID NO: 969 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaatttctactaagtgtagatcctcactcctgctcggtgaatttggccggcatggtcccagcctcctcgctggcgccggctgggcaacatgcttcggcatggcgaatgggac

SEQ ID NO: 970 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccagaatttctactgttgtagatcctcactcctgctcggtgaatttggccggcatggtcccagcctcctcgctggcgccggctgggcaacatgcttcggcatggcgaatgggac

SEQ ID NO: 971 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactcttgtagatcctcactcctgctcggtgaatttggccggcatggtcccagcctcctcgctggcgccggctgggcaacatgcttcggcatggcgaatgggac

SEQ ID NO: 972 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactattgtagatcctcactcctgctcggtgaatttggccggcatggtcccagcctcctcgctggcgccggctgggcaacatgcttcggcatggcgaatgggac

SEQ ID NO: 973 - DNA, 376 bp, synthetic construct; identical to SEQ ID NO: 971
  source 1..376: mol_type = other DNA

SEQ ID NO: 974 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctgaatttctactgttgtagatcctcactcctgctcggtgaatttggccggcatggtcccagcctcctcgctggcgccggctgggcaacatgcttcggcatggcgaatgggac

SEQ ID NO: 975 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactgttgtagatcctcactcctgctcggtgaatttggccggcatggtcccagcctcctcgctggcgccggctgggcaacatgcttcggcatggcgaatgggac

SEQ ID NO: 976 - DNA, 376 bp, synthetic construct; identical to SEQ ID NO: 972
  source 1..376: mol_type = other DNA

SEQ ID NO: 977 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatcctcactcctgctcggtgaatttggccggcatggtcccagcctcctcgctggcgccggctgggcaacatgcttcggcatggcgaatgggac

SEQ ID NO: 978 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagattgggactcaggcgggtcacctacggccggcatggtcccagcctcctcgctggcgccggctgggcaacatgcttcggcatggcgaatgggac

SEQ ID NO: 979 - DNA, 376 bp, synthetic construct; identical to SEQ ID NO: 708
  source 1..376: mol_type = other DNA

SEQ ID NO: 980 - DNA, 376 bp, synthetic construct; identical to SEQ ID NO: 709
  source 1..376: mol_type = other DNA

SEQ ID NO: 981 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatactcctgctcggtgaatttggctggccggcatggtcccagcctcctcgctggcgccggctgggcaacatgcttcggcatggcgaatgggac

SEQ ID NO: 982 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatcctcactcctgctcggtgaatttggccggcatggtcccagcctcctcgctggcgccggctgggcaacatgcttcggcatggcgaatgggac

SEQ ID NO: 983 - DNA, 376 bp, synthetic construct; identical to SEQ ID NO: 975
  source 1..376: mol_type = other DNA

SEQ ID NO: 984 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactattgtagatcctcactcctgctcggtgaatttggccggcatggtcccagcctcctcgctggcgccggctgggcaacatgcttcggcatggcgaatgggac

SEQ ID NO: 985 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactattgtagatcctcactcctgctcggtgaatttggccggcatggtcccagcctcctcgctggcgccggctgggcaacatgcttcggcatggcgaatgggac

SEQ ID NO: 986 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactgttgtagatcctcactcctgctcggtgaatttggccggcatggtcccagcctcctcgctggcgccggctgggcaacatgcttcggcatggcgaatgggac

SEQ ID NO: 987 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactctcgtagatcctcactcctgctcggtgaatttggccggcatggtcccagcctcctcgctggcgccggctgggcaacatgcttcggcatggcgaatgggac

SEQ ID NO: 988 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatggctctgggactcaggcgggtcaggccggcatggtcccagcctcctcgctggcgccggctgggcaacatgcttcggcatggcgaatgggac

SEQ ID NO: 989 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatgctcagcaggcacctgcctcagcggccggcatggtcccagcctcctcgctggcgccggctgggcaacatgcttcggcatggcgaatgggac

SEQ ID NO: 990 - DNA, 376 bp, synthetic construct; identical to SEQ ID NO: 975
  source 1..376: mol_type = other DNA

SEQ ID NO: 991 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatcctcactcctgctcggtgaatttggccggcatggtcccagcctcctcgctggcgccggctgggcaacatgcttcggcatggcgaatgggac

SEQ ID NO: 992 - DNA, 376 bp, synthetic construct; identical to SEQ ID NO: 970
  source 1..376: mol_type = other DNA

SEQ ID NO: 993 - DNA, 376 bp, synthetic construct; identical to SEQ ID NO: 985
  source 1..376: mol_type = other DNA

SEQ ID NO: 994 - DNA, 376 bp, synthetic construct; identical to SEQ ID NO: 985
  source 1..376: mol_type = other DNA

SEQ ID NO: 995 - DNA, 376 bp, synthetic construct; identical to SEQ ID NO: 972
  source 1..376: mol_type = other DNA

SEQ ID NO: 996 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagatcctcactcctgctcggtgaatttggccggcatggtcccagcctcctcgctggcgccggctgggcaacatgcttcggcatggcgaatgggac

SEQ ID NO: 997 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagatctgatggtccatgtctgttactcggccggcatggtcccagcctcctcgctggcgccggctgggcaacatgcttcggcatggcgaatgggac

SEQ ID NO: 998 - DNA, 376 bp, synthetic construct; identical to SEQ ID NO: 985
  source 1..376: mol_type = other DNA

SEQ ID NO: 999 - DNA, 376 bp, synthetic construct; identical to SEQ ID NO: 991
  source 1..376: mol_type = other DNA

SEQ ID NO: 1000 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctcaatttctactgttgtagatcctcactcctgctcggtgaatttggccggcatggtcccagcctcctcgctggcgccggctgggcaacatgcttcggcatggcgaatgggac

SEQ ID NO: 1001 - DNA, 376 bp, synthetic construct; identical to SEQ ID NO: 972
  source 1..376: mol_type = other DNA

SEQ ID NO: 1002 - DNA, 376 bp, synthetic construct; identical to SEQ ID NO: 978
  source 1..376: mol_type = other DNA

SEQ ID NO: 1003 - DNA, 376 bp, synthetic construct; identical to SEQ ID NO: 709
  source 1..376: mol_type = other DNA

SEQ ID NO: 1004 - DNA, 376 bp, synthetic construct; identical to SEQ ID NO: 708
  source 1..376: mol_type = other DNA

SEQ ID NO: 1005 - DNA, 376 bp, synthetic construct; identical to SEQ ID NO: 981
  source 1..376: mol_type = other DNA

SEQ ID NO: 1006 - DNA, 376 bp, synthetic construct; identical to SEQ ID NO: 986
  source 1..376: mol_type = other DNA

SEQ ID NO: 1007 - DNA, 376 bp, synthetic construct; identical to SEQ ID NO: 986
  source 1..376: mol_type = other DNA

SEQ ID NO: 1008 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatactcctgctcggtgaatttggctggccggcatggtcccagcctcctcgctggcgccggctgggcaacatgcttcggcatggcgaatgggac

SEQ ID NO: 1009 - DNA, 376 bp, synthetic construct; identical to SEQ ID NO: 712
  source 1..376: mol_type = other DNA

SEQ ID NO: 1010 - DNA, 376 bp, synthetic construct; identical to SEQ ID NO: 713
  source 1..376: mol_type = other DNA

SEQ ID NO: 1011 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaatttctactaagtgtagatcaggaggaagcgatggcttcagggccggcatggtcccagcctcctcgctggcgccggctgggcaacatgcttcggcatggcgaatgggac

SEQ ID NO: 1012 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccagaatttctactgttgtagatcaggaggaagcgatggcttcagggccggcatggtcccagcctcctcgctggcgccggctgggcaacatgcttcggcatggcgaatgggac

SEQ ID NO: 1013 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactcttgtagatcaggaggaagcgatggcttcagggccggcatggtcccagcctcctcgctggcgccggctgggcaacatgcttcggcatggcgaatgggac

SEQ ID NO: 1014 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactattgtagatcaggaggaagcgatggcttcagggccggcatggtcccagcctcctcgctggcgccggctgggcaacatgcttcggcatggcgaatgggac

SEQ ID NO: 1015 - DNA, 375 bp, synthetic construct; identical to SEQ ID NO: 1013
  source 1..375: mol_type = other DNA

SEQ ID NO: 1016 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctgaatttctactgttgtagatcaggaggaagcgatggcttcagggccggcatggtcccagcctcctcgctggcgccggctgggcaacatgcttcggcatggcgaatgggac

SEQ ID NO: 1017 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactgttgtagatcaggaggaagcgatggcttcagggccggcatggtcccagcctcctcgctggcgccggctgggcaacatgcttcggcatggcgaatgggac

SEQ ID NO: 1018 - DNA, 375 bp, synthetic construct; identical to SEQ ID NO: 1014
  source 1..375: mol_type = other DNA

SEQ ID NO: 1019 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatcaggaggaagcgatggcttcagggccggcatggtcccagcctcctcgctggcgccggctgggcaacatgcttcggcatggcgaatgggac

SEQ ID NO: 1020 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatagctttgcctgtaatgaaatggcggccggcatggtcccagcctcctcgctggcgccggctgggcaacatgcttcggcatggcgaatgggac

SEQ ID NO: 1021 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatggtgcagagatgcctcggtgcctggccggcatggtcccagcctcctcgctggcgccggctgggcaacatgcttcggcatggcgaatgggac

SEQ ID NO: 1022 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatcaggaggaagcgatggcttcagggccggcatggtcccagcctcctcgctggcgccggctgggcaacatgcttcggcatggcgaatgggac

SEQ ID NO: 1023 - DNA, 375 bp, synthetic construct; identical to SEQ ID NO: 1017
  source 1..375: mol_type = other DNA

SEQ ID NO: 1024 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactattgtagatcaggaggaagcgatggcttcagggccggcatggtcccagcctcctcgctggcgccggctgggcaacatgcttcggcatggcgaatgggac

SEQ ID NO: 1025 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactattgtagatcaggaggaagcgatggcttcagggccggcatggtcccagcctcctcgctggcgccggctgggcaacatgcttcggcatggcgaatgggac

SEQ ID NO: 1026 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactgttgtagatcaggaggaagcgatggcttcagggccggcatggtcccagcctcctcgctggcgccggctgggcaacatgcttcggcatggcgaatgggac

SEQ ID NO: 1027 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactctcgtagatcaggaggaagcgatggcttcagggccggcatggtcccagcctcctcgctggcgccggctgggcaacatgcttcggcatggcgaatgggac

SEQ ID NO: 1028 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagattttttacaaaggtgcattttttaggccggcatggtcccagcctcctcgctggcgccggctgggcaacatgcttcggcatggcgaatgggac

SEQ ID NO: 1029 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatctcagctttgcctgtaatgaaatggccggcatggtcccagcctcctcgctggcgccggctgggcaacatgcttcggcatggcgaatgggac

SEQ ID NO: 1030 - DNA, 375 bp, synthetic construct; identical to SEQ ID NO: 1017
  source 1..375: mol_type = other DNA

SEQ ID NO: 1031 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatcaggaggaagcgatggcttcagggccggcatggtcccagcctcctcgctggcgccggctgggcaacatgcttcggcatggcgaatgggac

SEQ ID NO: 1032 - DNA, 375 bp, synthetic construct; identical to SEQ ID NO: 1012
  source 1..375: mol_type = other DNA

SEQ ID NO: 1033 - DNA, 375 bp, synthetic construct; identical to SEQ ID NO: 1025
  source 1..375: mol_type = other DNA

SEQ ID NO: 1034 - DNA, 375 bp, synthetic construct; identical to SEQ ID NO: 1025
  source 1..375: mol_type = other DNA

SEQ ID NO: 1035 - DNA, 375 bp, synthetic construct; identical to SEQ ID NO: 1014
  source 1..375: mol_type = other DNA

SEQ ID NO: 1036 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagatagacagcatatttgagtcatttcggccggcatggtcccagcctcctcgctggcgccggctgggcaacatgcttcggcatggcgaatgggac

SEQ ID NO: 1037 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagatacctcggtgcagagatgcctcggggccggcatggtcccagcctcctcgctggcgccggctgggcaacatgcttcggcatggcgaatgggac

SEQ ID NO: 1038 - DNA, 375 bp, synthetic construct; identical to SEQ ID NO: 1025
  source 1..375: mol_type = other DNA

SEQ ID NO: 1039 - DNA, 375 bp, synthetic construct; identical to SEQ ID NO: 1031
  source 1..375: mol_type = other DNA

SEQ ID NO: 1040 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctcaatttctactgttgtagatcaggaggaagcgatggcttcagggccggcatggtcccagcctcctcgctggcgccggctgggcaacatgcttcggcatggcgaatgggac

SEQ ID NO: 1041 - DNA, 375 bp, synthetic construct; identical to SEQ ID NO: 1014
  source 1..375: mol_type = other DNA

SEQ ID NO: 1042 - DNA, 375 bp, synthetic construct; identical to SEQ ID NO: 1031
  source 1..375: mol_type = other DNA

SEQ ID NO: 1043 - DNA, 375 bp, synthetic construct; identical to SEQ ID NO: 1026
  source 1..375: mol_type = other DNA

SEQ ID NO: 1044 - DNA, 375 bp, synthetic construct; identical to SEQ ID NO: 1026
  source 1..375: mol_type = other DNA

SEQ ID NO: 1045 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatagctttgcctgtaatgaaatggcggccggcatggtcccagcctcctcgctggcgccggctgggcaacatgcttcggcatggcgaatgggac

SEQ ID NO: 1046 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatggtgcagagatgcctcggtgcctggccggcatggtcccagcctcctcgctggcgccggctgggcaacatgcttcggcatggcgaatgggac

SEQ ID NO: 1047 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaatttctactaagtgtagatctccatcttgtcatcctgcaggccggcatggtcccagcctcctcgctggcgccggctgggcaacatgcttcggcatggcgaatgggac

SEQ ID NO: 1048 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccagaatttctactgttgtagatctccatcttgtcatcctgcaggccggcatggtcccagcctcctcgctggcgccggctgggcaacatgcttcggcatggcgaatgggac

SEQ ID NO: 1049 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactcttgtagatctccatcttgtcatcctgcaggccggcatggtcccagcctcctcgctggcgccggctgggcaacatgcttcggcatggcgaatgggac

SEQ ID NO: 1050 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactattgtagatctccatcttgtcatcctgcaggccggcatggtcccagcctcctcgctggcgccggctgggcaacatgcttcggcatggcgaatgggac

SEQ ID NO: 1051 - DNA, 373 bp, synthetic construct; identical to SEQ ID NO: 1049
  source 1..373: mol_type = other DNA

SEQ ID NO: 1052 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctgaatttctactgttgtagatctccatcttgtcatcctgcaggccggcatggtcccagcctcctcgctggcgccggctgggcaacatgcttcggcatggcgaatgggac

SEQ ID NO: 1053 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactgttgtagatctccatcttgtcatcctgcaggccggcatggtcccagcctcctcgctggcgccggctgggcaacatgcttcggcatggcgaatgggac

SEQ ID NO: 1054 - DNA, 373 bp, synthetic construct; identical to SEQ ID NO: 1050
  source 1..373: mol_type = other DNA

SEQ ID NO: 1055 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatctccatcttgtcatcctgcaggccggcatggtcccagcctcctcgctggcgccggctgggcaacatgcttcggcatggcgaatgggac

SEQ ID NO: 1056 - DNA, 376 bp, synthetic construct; identical to SEQ ID NO: 714
  source 1..376: mol_type = other DNA

SEQ ID NO: 1057 - DNA, 376 bp, synthetic construct; identical to SEQ ID NO: 715
  source 1..376: mol_type = other DNA

SEQ ID NO: 1058 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatctccatcttgtcatcctgcaggccggcatggtcccagcctcctcgctggcgccggctgggcaacatgcttcggcatggcgaatgggac

SEQ ID NO: 1059 - DNA, 373 bp, synthetic construct; identical to SEQ ID NO: 1053
  source 1..373: mol_type = other DNA

SEQ ID NO: 1060 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactattgtagatctccatcttgtcatcctgcaggccggcatggtcccagcctcctcgctggcgccggctgggcaacatgcttcggcatggcgaatgggac

SEQ ID NO: 1061 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactattgtagatctccatcttgtcatcctgcaggccggcatggtcccagcctcctcgctggcgccggctgggcaacatgcttcggcatggcgaatgggac

SEQ ID NO: 1062 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactgttgtagatctccatcttgtcatcctgcaggccggcatggtcccagcctcctcgctggcgccggctgggcaacatgcttcggcatggcgaatgggac

SEQ ID NO: 1063 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactctcgtagatctccatcttgtcatcctgcaggccggcatggtcccagcctcctcgctggcgccggctgggcaacatgcttcggcatggcgaatgggac

SEQ ID NO: 1064 - DNA, 373 bp, synthetic construct; identical to SEQ ID NO: 1058
  source 1..373: mol_type = other DNA

SEQ ID NO: 1065 - DNA, 373 bp, synthetic construct; identical to SEQ ID NO: 1053
  source 1..373: mol_type = other DNA

SEQ ID NO: 1066 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatctccatcttgtcatcctgcaggccggcatggtcccagcctcctcgctggcgccggctgggcaacatgcttcggcatggcgaatgggac

SEQ ID NO: 1067 - DNA, 373 bp, synthetic construct; identical to SEQ ID NO: 1048
  source 1..373: mol_type = other DNA

SEQ ID NO: 1068 - DNA, 373 bp, synthetic construct; identical to SEQ ID NO: 1061
  source 1..373: mol_type = other DNA

SEQ ID NO: 1069 - DNA, 373 bp, synthetic construct; identical to SEQ ID NO: 1061
  source 1..373: mol_type = other DNA

SEQ ID NO: 1070 - DNA, 373 bp, synthetic construct; identical to SEQ ID NO: 1050
  source 1..373: mol_type = other DNA

SEQ ID NO: 1071 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagattttgccttttcttctgcaatgcgggccggcatggtcccagcctcctcgctggcgccggctgggcaacatgcttcggcatggcgaatgggac

SEQ ID NO: 1072 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagattctggtgaagaagttgaagctgtggccggcatggtcccagcctcctcgctggcgccggctgggcaacatgcttcggcatggcgaatgggac

SEQ ID NO: 1073 - DNA, 373 bp, synthetic construct; identical to SEQ ID NO: 1061
  source 1..373: mol_type = other DNA

SEQ ID NO: 1074 - DNA, 373 bp, synthetic construct; identical to SEQ ID NO: 1066
  source 1..373: mol_type = other DNA

SEQ ID NO: 1075 - DNA, 373 bp, synthetic construct
  source 1..373: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctcaatttctactgttgtagatctccatcttgtcatcctgcaggccggcatggtcccagcctcctcgctggcgccggctgggcaacatgcttcggcatggcgaatgggac

SEQ ID NO: 1076 - DNA, 373 bp, synthetic construct; identical to SEQ ID NO: 1050
  source 1..373: mol_type = other DNA

SEQ ID NO: 1077 - DNA, 373 bp, synthetic construct; identical to SEQ ID NO: 1066
  source 1..373: mol_type = other DNA

SEQ ID NO: 1078 - DNA, 373 bp, synthetic construct; identical to SEQ ID NO: 1062
  source 1..373: mol_type = other DNA

SEQ ID NO: 1079 - DNA, 373 bp, synthetic construct; identical to SEQ ID NO: 1062
  source 1..373: mol_type = other DNA

SEQ ID NO: 1080 - DNA, 376 bp, synthetic construct; identical to SEQ ID NO: 718
  source 1..376: mol_type = other DNA

SEQ ID NO: 1081 - DNA, 376 bp, synthetic construct; identical to SEQ ID NO: 719
  source 1..376: mol_type = other DNA

SEQ ID NO: 1082 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaatttctactaagtgtagatgtcggcatggccccattcgcacgggccggcatggtcccagcctcctcgctggcgccggctgggcaacatgcttcggcatggcgaatgggac

SEQ ID NO: 1083 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccagaatttctactgttgtagatgtcggcatggccccattcgcacgggccggcatggtcccagcctcctcgctggcgccggctgggcaacatgcttcggcatggcgaatgggac

SEQ ID NO: 1084 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactcttgtagatgtcggcatggccccattcgcacgggccggcatggtcccagcctcctcgctggcgccggctgggcaacatgcttcggcatggcgaatgggac

SEQ ID NO: 1085 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactattgtagatgtcggcatggccccattcgcacgggccggcatggtcccagcctcctcgctggcgccggctgggcaacatgcttcggcatggcgaatgggac

SEQ ID NO: 1086 - DNA, 376 bp, synthetic construct; identical to SEQ ID NO: 1084
  source 1..376: mol_type = other DNA

SEQ ID NO: 1087 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctgaatttctactgttgtagatgtcggcatggccccattcgcacgggccggcatggtcccagcctcctcgctggcgccggctgggcaacatgcttcggcatggcgaatgggac

SEQ ID NO: 1088 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactgttgtagatgtcggcatggccccattcgcacgggccggcatggtcccagcctcctcgctggcgccggctgggcaacatgcttcggcatggcgaatgggac

SEQ ID NO: 1089 - DNA, 376 bp, synthetic construct; identical to SEQ ID NO: 1085
  source 1..376: mol_type = other DNA

SEQ ID NO: 1090 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatgtcggcatggccccattcgcacgggccggcatggtcccagcctcctcgctggcgccggctgggcaacatgcttcggcatggcgaatgggac

SEQ ID NO: 1091 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatatggaatcccttctgcagcacctggccggcatggtcccagcctcctcgctggcgccggctgggcaacatgcttcggcatggcgaatgggac

SEQ ID NO: 1092 - DNA, 376 bp, synthetic construct; identical to SEQ ID NO: 720
  source 1..376: mol_type = other DNA

SEQ ID NO: 1093 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatgtcggcatggccccattcgcacgggccggcatggtcccagcctcctcgctggcgccggctgggcaacatgcttcggcatggcgaatgggac

SEQ ID NO: 1094 - DNA, 376 bp, synthetic construct; identical to SEQ ID NO: 1088
  source 1..376: mol_type = other DNA

SEQ ID NO: 1095 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactattgtagatgtcggcatggccccattcgcacgggccggcatggtcccagcctcctcgctggcgccggctgggcaacatgcttcggcatggcgaatgggac

SEQ ID NO: 1096 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactattgtagatgtcggcatggccccattcgcacgggccggcatggtcccagcctcctcgctggcgccggctgggcaacatgcttcggcatggcgaatgggac

SEQ ID NO: 1097 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactgttgtagatgtcggcatggccccattcgcacgggccggcatggtcccagcctcctcgctggcgccggctgggcaacatgcttcggcatggcgaatgggac

SEQ ID NO: 1098 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactctcgtagatgtcggcatggccccattcgcacgggccggcatggtcccagcctcctcgctggcgccggctgggcaacatgcttcggcatggcgaatgggac

SEQ ID NO: 1099 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagattcctaaaaattacgaaaacgaaaggccggcatggtcccagcctcctcgctggcgccggctgggcaacatgcttcggcatggcgaatgggac

SEQ ID NO: 1100 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagataaaaacctcaacacagattctagggccggcatggtcccagcctcctcgctggcgccggctgggcaacatgcttcggcatggcgaatgggac

SEQ ID NO: 1101 - DNA, 376 bp, synthetic construct; identical to SEQ ID NO: 1088
  source 1..376: mol_type = other DNA

SEQ ID NO: 1102 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatgtcggcatggccccattcgcacgggccggcatggtcccagcctcctcgctggcgccggctgggcaacatgcttcggcatggcgaatgggac

SEQ ID NO: 1103 - DNA, 376 bp, synthetic construct; identical to SEQ ID NO: 1083
  source 1..376: mol_type = other DNA

SEQ ID NO: 1104 - DNA, 376 bp, synthetic construct; identical to SEQ ID NO: 1096
  source 1..376: mol_type = other DNA

SEQ ID NO: 1105 - DNA, 376 bp, synthetic construct; identical to SEQ ID NO: 1096
  source 1..376: mol_type = other DNA

SEQ ID NO: 1106 - DNA, 376 bp, synthetic construct; identical to SEQ ID NO: 1085
  source 1..376: mol_type = other DNA

SEQ ID NO: 1107 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagataaataatctgggcttcagttctaggccggcatggtcccagcctcctcgctggcgccggctgggcaacatgcttcggcatggcgaatgggac

SEQ ID NO: 1108 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaaatttctactatcgtagatctcacgtcacagtatgtctctggggccggcatggtcccagcctcctcgctggcgccggctgggcaacatgcttcggcatggcgaatgggac

SEQ ID NO: 1109 - DNA, 376 bp, synthetic construct; identical to SEQ ID NO: 1096
  source 1..376: mol_type = other DNA

SEQ ID NO: 1110 - DNA, 376 bp, synthetic construct; identical to SEQ ID NO: 1102
  source 1..376: mol_type = other DNA

SEQ ID NO: 1111 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctcaatttctactgttgtagatgtcggcatggccccattcgcacgggccggcatggtcccagcctcctcgctggcgccggctgggcaacatgcttcggcatggcgaatgggac

SEQ ID NO: 1112 - DNA, 376 bp, synthetic construct; identical to SEQ ID NO: 1085
  source 1..376: mol_type = other DNA

SEQ ID NO: 1113 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagattggcgttacttaattttgaaaaaggccggcatggtcccagcctcctcgctggcgccggctgggcaacatgcttcggcatggcgaatgggac

SEQ ID NO: 1114 - DNA, 376 bp, synthetic construct; identical to SEQ ID NO: 720
  source 1..376: mol_type = other DNA

SEQ ID NO: 1115 - DNA, 376 bp, synthetic construct; identical to SEQ ID NO: 1097
  source 1..376: mol_type = other DNA

SEQ ID NO: 1116 - DNA, 376 bp, synthetic construct; identical to SEQ ID NO: 1097
  source 1..376: mol_type = other DNA

SEQ ID NO: 1117 - DNA, 376 bp, synthetic construct
  source 1..376: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagattggcgttacttaattttgaaaaaggccggcatggtcccagcctcctcgctggcgccggctgggcaacatgcttcggcatggcgaatgggac

SEQ ID NO: 1118 - DNA, 376 bp, synthetic construct; identical to SEQ ID NO: 722
  source 1..376: mol_type = other DNA

SEQ ID NO: 1119 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaatttctactaagtgtagatgcggatgttccaatcagtacgcggccggcatggtcccagcctcctcgctggcgccggctgggcaacatgcttcggcatggcgaatgggac

SEQ ID NO: 1120 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccagaatttctactgttgtagatgcggatgttccaatcagtacgcggccggcatggtcccagcctcctcgctggcgccggctgggcaacatgcttcggcatggcgaatgggac

SEQ ID NO: 1121 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactcttgtagatgcggatgttccaatcagtacgcggccggcatggtcccagcctcctcgctggcgccggctgggcaacatgcttcggcatggcgaatgggac

SEQ ID NO: 1122 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctactattgtagatgcggatgttccaatcagtacgcggccggcatggtcccagcctcctcgctggcgccggctgggcaacatgcttcggcatggcgaatgggac

SEQ ID NO: 1123 - DNA, 375 bp, synthetic construct; identical to SEQ ID NO: 1121
  source 1..375: mol_type = other DNA

SEQ ID NO: 1124 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctgaatttctactgttgtagatgcggatgttccaatcagtacgcggccggcatggtcccagcctcctcgctggcgccggctgggcaacatgcttcggcatggcgaatgggac

SEQ ID NO: 1125 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactgttgtagatgcggatgttccaatcagtacgcggccggcatggtcccagcctcctcgctggcgccggctgggcaacatgcttcggcatggcgaatgggac

SEQ ID NO: 1126 - DNA, 375 bp, synthetic construct; identical to SEQ ID NO: 1122
  source 1..375: mol_type = other DNA

SEQ ID NO: 1127 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccaaaatttctgctattgcagatgcggatgttccaatcagtacgcggccggcatggtcccagcctcctcgctggcgccggctgggcaacatgcttcggcatggcgaatgggac

SEQ ID NO: 1128 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactatcgtagatgcggatgttccaatcagtacgcggccggcatggtcccagcctcctcgctggcgccggctgggcaacatgcttcggcatggcgaatgggac

SEQ ID NO: 1129 - DNA, 375 bp, synthetic construct; identical to SEQ ID NO: 1125
  source 1..375: mol_type = other DNA

SEQ ID NO: 1130 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactattgtagatgcggatgttccaatcagtacgcggccggcatggtcccagcctcctcgctggcgccggctgggcaacatgcttcggcatggcgaatgggac

SEQ ID NO: 1131 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactattgtagatgcggatgttccaatcagtacgcggccggcatggtcccagcctcctcgctggcgccggctgggcaacatgcttcggcatggcgaatgggac

SEQ ID NO: 1132 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccataatttctactgttgtagatgcggatgttccaatcagtacgcggccggcatggtcccagcctcctcgctggcgccggctgggcaacatgcttcggcatggcgaatgggac

SEQ ID NO: 1133 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccttaatttctactctcgtagatgcggatgttccaatcagtacgcggccggcatggtcccagcctcctcgctggcgccggctgggcaacatgcttcggcatggcgaatgggac

SEQ ID NO: 1134 - DNA, 375 bp, synthetic construct; identical to SEQ ID NO: 1125
  source 1..375: mol_type = other DNA

SEQ ID NO: 1135 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctaaatttctactattgtagatgcggatgttccaatcagtacgcggccggcatggtcccagcctcctcgctggcgccggctgggcaacatgcttcggcatggcgaatgggac

SEQ ID NO: 1136 - DNA, 375 bp, synthetic construct; identical to SEQ ID NO: 1120
  source 1..375: mol_type = other DNA

SEQ ID NO: 1137 - DNA, 375 bp, synthetic construct; identical to SEQ ID NO: 1131
  source 1..375: mol_type = other DNA

SEQ ID NO: 1138 - DNA, 375 bp, synthetic construct; identical to SEQ ID NO: 1131
  source 1..375: mol_type = other DNA

SEQ ID NO: 1139 - DNA, 375 bp, synthetic construct; identical to SEQ ID NO: 1122
  source 1..375: mol_type = other DNA

SEQ ID NO: 1140 - DNA, 375 bp, synthetic construct; identical to SEQ ID NO: 1131
  source 1..375: mol_type = other DNA

SEQ ID NO: 1141 - DNA, 375 bp, synthetic construct; identical to SEQ ID NO: 1135
  source 1..375: mol_type = other DNA

SEQ ID NO: 1142 - DNA, 375 bp, synthetic construct
  source 1..375: mol_type = other DNA
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacctcaatttctactgttgtagatgcggatgttccaatcagtacgcggccggcatggtcccagcctcctcgctggcgccggctgggcaacatgcttcggcatggcgaatgggac

SEQ ID NO: 1143 - DNA, 375 bp, synthetic construct; identical to SEQ ID NO: 1122
  source 1..375: mol_type = other DNA

SEQ ID NO: 1144 - DNA, 375 bp, synthetic construct; identical to SEQ ID NO: 1132
  source 1..375: mol_type = other DNA

SEQ ID NO: 1145 - DNA, 375 bp, synthetic construct; identical to SEQ ID NO: 1132
  source 1..375: mol_type = other DNA

SEQ ID NO: 1146 - RNA, 44 nt, synthetic construct
  source 1..44: mol_type = other RNA
taatttctactaagtgtagatcctcactcctgctcggtgaattt

SEQ ID NO: 1147 - RNA, 44 nt, synthetic construct
  source 1..44: mol_type = other RNA
agaatttctactgttgtagatcctcactcctgctcggtgaattt

SEQ ID NO: 1148 - RNA, 44 nt, synthetic construct
  source 1..44: mol_type = other RNA
aaaatttctactcttgtagatcctcactcctgctcggtgaattt

SEQ ID NO: 1149 - RNA, 44 nt, synthetic construct
  source 1..44: mol_type = other RNA
aaaatttctactattgtagatcctcactcctgctcggtgaattt

SEQ ID NO: 1150 - RNA, 44 nt, synthetic construct; identical to SEQ ID NO: 1148
  source 1..44: mol_type = other RNA

SEQ ID NO: 1151 - RNA, 44 nt, synthetic construct
  source 1..44: mol_type = other RNA
tgaatttctactgttgtagatcctcactcctgctcggtgaattt

SEQ ID NO: 1152 - RNA, 44 nt, synthetic construct
  source 1..44: mol_type = other RNA
taaatttctactgttgtagatcctcactcctgctcggtgaattt

SEQ ID NO: 1153 - RNA, 44 nt, synthetic construct; identical to SEQ ID NO: 1149
  source 1..44: mol_type = other RNA

SEQ ID NO: 1154 - RNA, 44 nt, synthetic construct
  source 1..44: mol_type = other RNA
aaaatttctgctattgcagatcctcactcctgctcggtgaattt

SEQ ID NO: 1155 - RNA, 44 nt, synthetic construct
  source 1..44: mol_type = other RNA
taaatttctactattgtagattgggactcaggcgggtcacctac

SEQ ID NO: 1156 - RNA, 44 nt, synthetic construct; identical to SEQ ID NO: 693
  source 1..44: mol_type = other RNA

SEQ ID NO: 1157 - RNA, 44 nt, synthetic construct; identical to SEQ ID NO: 694
  source 1..44: mol_type = other RNA

SEQ ID NO: 1158 - RNA, 44 nt, synthetic construct
  source 1..44: mol_type = other RNA
taaatttctactattgtagatactcctgctcggtgaatttggct

SEQ ID NO: 1159 - RNA, 44 nt, synthetic construct
  source 1..44: mol_type = other RNA
ataatttctactatcgtagatcctcactcctgctcggtgaattt

SEQ ID NO: 1160 - RNA, 44 nt, synthetic construct; identical to SEQ ID NO: 1152
  source 1..44: mol_type = other RNA

SEQ ID NO: 1161 - RNA, 44 nt, synthetic construct
  source 1..44: mol_type = other RNA
ttaatttctactattgtagatcctcactcctgctcggtgaattt

SEQ ID NO: 1162 - RNA, 44 nt, synthetic construct
  source 1..44: mol_type = other RNA
ataatttctactattgtagatcctcactcctgctcggtgaattt

SEQ ID NO: 1163 - RNA, 44 nt, synthetic construct
  source 1..44: mol_type = other RNA
ataatttctactgttgtagatcctcactcctgctcggtgaattt

SEQ ID NO: 1164 - RNA, 44 nt, synthetic construct
  source 1..44: mol_type = other RNA
ttaatttctactctcgtagatcctcactcctgctcggtgaattt

SEQ ID NO: 1165 - RNA, 44 nt, synthetic construct
  source 1..44: mol_type = other RNA
ataatttctactatcgtagatggctctgggactcaggcgggtca

SEQ ID NO: 1166 - RNA, 44 nt, synthetic construct
  source 1..44: mol_type = other RNA
ataatttctactatcgtagatgctcagcaggcacctgcctcagc

SEQ ID NO: 1167 - RNA, 44 nt, synthetic construct; identical to SEQ ID NO: 1152
  source 1..44: mol_type = other RNA

SEQ ID NO: 1168 - RNA, 44 nt, synthetic construct
  source 1..44: mol_type = other RNA
taaatttctactattgtagatcctcactcctgctcggtgaattt

SEQ ID NO: 1169 - RNA, 44 nt, synthetic construct; identical to SEQ ID NO: 1147
  source 1..44: mol_type = other RNA

SEQ ID NO: 1170 - RNA, 44 nt, synthetic construct; identical to SEQ ID NO: 1162
  source 1..44: mol_type = other RNA

SEQ ID NO: 1171 - RNA, 44 nt, synthetic construct; identical to SEQ ID NO: 1162
  source 1..44: mol_type = other RNA

SEQ ID NO: 1172 - RNA, 44 nt, synthetic construct; identical to SEQ ID NO: 1149
  source 1..44: mol_type = other RNA

SEQ ID NO: 1173 - RNA, 44 nt, synthetic construct
  source 1..44: mol_type = other RNA
gaaatttctactatcgtagatcctcactcctgctcggtgaattt

SEQ ID NO: 1174 - RNA, 44 nt, synthetic construct
  source 1..44: mol_type = other RNA
gaaatttctactatcgtagatctgatggtccatgtctgttactc

SEQ ID NO: 1175 - RNA, 44 nt, synthetic construct; identical to SEQ ID NO: 1162
  source 1..44: mol_type = other RNA

SEQ ID NO: 1176 - RNA, 44 nt, synthetic construct; identical to SEQ ID NO: 1168
  source 1..44: mol_type = other RNA

SEQ ID NO: 1177 - RNA, 44 nt, synthetic construct
  source 1..44: mol_type = other RNA
tcaatttctactgttgtagatcctcactcctgctcggtgaattt

SEQ ID NO: 1178 - RNA, 44 nt, synthetic construct; identical to SEQ ID NO: 1149
  source 1..44: mol_type = other RNA

SEQ ID NO: 1179 - RNA, 44 nt, synthetic construct; identical to SEQ ID NO: 1155
  source 1..44: mol_type = other RNA

SEQ ID NO: 1180 - RNA, 44 nt, synthetic construct; identical to SEQ ID NO: 694
  source 1..44: mol_type = other RNA

SEQ ID NO: 1181 - RNA, 44 nt, synthetic construct; identical to SEQ ID NO: 693
  source 1..44: mol_type = other RNA

SEQ ID NO: 1182 - RNA, 44 nt, synthetic construct; identical to SEQ ID NO: 1158
  source 1..44: mol_type = other RNA

SEQ ID NO: 1183 - RNA, 44 nt, synthetic construct; identical to SEQ ID NO: 1163
  source 1..44: mol_type = other RNA

SEQ ID NO: 1184 - RNA, 44 nt, synthetic construct; identical to SEQ ID NO: 1163
  source 1..44: mol_type = other RNA

SEQ ID NO: 1185 - RNA, 44 nt, synthetic construct
  source 1..44: mol_type = other RNA
aaaatttctgctattgcagatactcctgctcggtgaatttggct

SEQ ID NO: 1186 - RNA, 44 nt, synthetic construct; identical to SEQ ID NO: 697
  source 1..44: mol_type = other RNA

SEQ ID NO: 1187 - RNA, 44 nt, synthetic construct; identical to SEQ ID NO: 698
  source 1..44: mol_type = other RNA

SEQ ID NO: 1188 - RNA, 43 nt, synthetic construct
  source 1..43: mol_type = other RNA
taatttctactaagtgtagatcaggaggaagcgatggcttcag

SEQ ID NO: 1189 - RNA, 43 nt, synthetic construct
  source 1..43: mol_type = other RNA
agaatttctactgttgtagatcaggaggaagcgatggcttcag

SEQ ID NO: 1190 - RNA, 43 nt, synthetic construct
  source 1..43: mol_type = other RNA
aaaatttctactcttgtagatcaggaggaagcgatggcttcag

SEQ ID NO: 1191 - RNA, 43 nt, synthetic construct
  source 1..43: mol_type = other RNA
aaaatttctactattgtagatcaggaggaagcgatggcttcag

SEQ ID NO: 1192 - RNA, 43 nt, synthetic construct; identical to SEQ ID NO: 1190
  source 1..43: mol_type = other RNA

SEQ ID NO: 1193 - RNA, 43 nt, synthetic construct
  source 1..43: mol_type = other RNA
tgaatttctactgttgtagatcaggaggaagcgatggcttcag

SEQ ID NO: 1194 - RNA, 43 nt, synthetic construct
  source 1..43: mol_type = other RNA
taaatttctactgttgtagatcaggaggaagcgatggcttcag

SEQ ID NO: 1195 - RNA, 43 nt, synthetic construct; identical to SEQ ID NO: 1191
  source 1..43: mol_type = other RNA

SEQ ID NO: 1196 - RNA, 43 nt, synthetic construct
  source 1..43: mol_type = other RNA
aaaatttctgctattgcagatcaggaggaagcgatggcttcag

SEQ ID NO: 1197 - RNA, 44 nt, synthetic construct
  source 1..44: mol_type = other RNA
taaatttctactattgtagatagctttgcctgtaatgaaatggc

SEQ ID NO: 1198 - RNA, 44 nt, synthetic construct
  source 1..44: mol_type = other RNA
taaatttctactattgtagatggtgcagagatgcctcggtgcct

SEQ ID NO: 1199 - RNA, 43 nt, synthetic construct
  source 1..43: mol_type = other RNA
ataatttctactatcgtagatcaggaggaagcgatggcttcag

SEQ ID NO: 1200 - RNA, 43 nt, synthetic construct; identical to SEQ ID NO: 1194
  source 1..43: mol_type = other RNA

SEQ ID NO: 1201 - RNA, 43 nt, synthetic construct
  source 1..43: mol_type = other RNA
ttaatttctactattgtagatcaggaggaagcgatggcttcag

SEQ ID NO: 1202 - RNA, 43 nt, synthetic construct
  source 1..43: mol_type = other RNA
ataatttctactattgtagatcaggaggaagcgatggcttcag

SEQ ID NO: 1203 - RNA, 43 nt, synthetic construct
  source 1..43: mol_type = other RNA
ataatttctactgttgtagatcaggaggaagcgatggcttcag

SEQ ID NO: 1204 - RNA, 43 nt, synthetic construct
  source 1..43: mol_type = other RNA
ttaatttctactctcgtagatcaggaggaagcgatggcttcag

SEQ ID NO: 1205 - RNA, 44 nt, synthetic construct
  source 1..44: mol_type = other RNA
ataatttctactatcgtagattttttacaaaggtgcatttttta

SEQ ID NO: 1206 - RNA, 44 nt, synthetic construct
  source 1..44: mol_type = other RNA
ataatttctactatcgtagatctcagctttgcctgtaatgaaat

SEQ ID NO: 1207 - RNA, 43 nt, synthetic construct; identical to SEQ ID NO: 1194
  source 1..43: mol_type = other RNA

SEQ ID NO: 1208 - RNA, 43 nt, synthetic construct
  source 1..43: mol_type = other RNA
taaatttctactattgtagatcaggaggaagcgatggcttcag

SEQ ID NO: 1209 - RNA, 43 nt, synthetic construct; identical to SEQ ID NO: 1189
  source 1..43: mol_type = other RNA

SEQ ID NO: 1210 - RNA, 43 nt, synthetic construct; identical to SEQ ID NO: 1202
  source 1..43: mol_type = other RNA

SEQ ID NO: 1211 - RNA, 43 nt, synthetic construct; identical to SEQ ID NO: 1202
  source 1..43: mol_type = other RNA

SEQ ID NO: 1212 - RNA, 43 nt, synthetic construct; identical to SEQ ID NO: 1191
  source 1..43: mol_type = other RNA

SEQ ID NO: 1213 - RNA, 44 nt, synthetic construct
  source 1..44: mol_type = other RNA
gaaatttctactatcgtagatagacagcatatttgagtcatttc

SEQ ID NO: 1214 - RNA, 44 nt, synthetic construct
  source 1..44: mol_type = other RNA
gaaatttctactatcgtagatacctcggtgcagagatgcctcgg

SEQ ID NO: 1215 - RNA, 43 nt, synthetic construct; identical to SEQ ID NO: 1202
  source 1..43: mol_type = other RNA

SEQ ID NO: 1216 - RNA, 43 nt, synthetic construct; identical to SEQ ID NO: 1208
  source 1..43: mol_type = other RNA

SEQ ID NO: 1217 - RNA, 43 nt, synthetic construct
  source 1..43: mol_type = other RNA
tcaatttctactgttgtagatcaggaggaagcgatggcttcag

SEQ ID NO: 1218 - RNA, 43 nt, synthetic construct; identical to SEQ ID NO: 1191
  source 1..43: mol_type = other RNA

SEQ ID NO: 1219 - RNA, 43 nt, synthetic construct; identical to SEQ ID NO: 1208
  source 1..43: mol_type = other RNA

SEQ ID NO: 1220 - RNA, 43 nt, synthetic construct; identical to SEQ ID NO: 1203
  source 1..43: mol_type = other RNA

SEQ ID NO: 1221 - RNA, 43 nt, synthetic construct; identical to SEQ ID NO: 1203
  source 1..43: mol_type = other RNA

SEQ ID NO: 1222 - RNA, 44 nt, synthetic construct
  source 1..44: mol_type = other RNA
aaaatttctgctattgcagatagctttgcctgtaatgaaatggc

SEQ ID NO: 1223 - RNA, 44 nt, synthetic construct
  source 1..44: mol_type = other RNA
aaaatttctgctattgcagatggtgcagagatgcctcggtgcct

SEQ ID NO: 1224 - RNA, 41 nt, synthetic construct
  source 1..41: mol_type = other RNA
taatttctactaagtgtagatctccatcttgtcatcctgca

SEQ ID NO: 1225 - RNA, 41 nt, synthetic construct
  source 1..41: mol_type = other RNA
agaatttctactgttgtagatctccatcttgtcatcctgca

SEQ ID NO: 1226 - RNA, 41 nt, synthetic construct
  source 1..41: mol_type = other RNA
aaaatttctactcttgtagatctccatcttgtcatcctgca

SEQ ID NO: 1227 - RNA, 41 nt, synthetic construct
  source 1..41: mol_type = other RNA
aaaatttctactattgtagatctccatcttgtcatcctgca

SEQ ID NO: 1228 - RNA, 41 nt, synthetic construct; identical to SEQ ID NO: 1226
  source 1..41: mol_type = other RNA

SEQ ID NO: 1229 - RNA, 41 nt, synthetic construct
  source 1..41: mol_type = other RNA
tgaatttctactgttgtagatctccatcttgtcatcctgca

SEQ ID NO: 1230 - RNA, 41 nt, synthetic construct
  source 1..41: mol_type = other RNA
taaatttctactgttgtagatctccatcttgtcatcctgca

SEQ ID NO: 1231 - RNA, 41 nt, synthetic construct; identical to SEQ ID NO: 1227
  source 1..41: mol_type = other RNA

SEQ ID NO: 1232 - RNA, 41 nt, synthetic construct
  source 1..41: mol_type = other RNA
aaaatttctgctattgcagatctccatcttgtcatcctgca

SEQ ID NO: 1233 - RNA, 44 nt, synthetic construct; identical to SEQ ID NO: 699
  source 1..44: mol_type = other RNA

SEQ ID NO: 1234 - RNA, 44 nt, synthetic construct; identical to SEQ ID NO: 700
  source 1..44: mol_type = other RNA

SEQ ID NO: 1235 - RNA, 41 nt, synthetic construct
  source 1..41: mol_type = other RNA
ataatttctactatcgtagatctccatcttgtcatcctgca

SEQ ID NO: 1236 - RNA, 41 nt, synthetic construct; identical to SEQ ID NO: 1230
  source 1..41: mol_type = other RNA

SEQ ID NO: 1237 - RNA, 41 nt, synthetic construct
  source 1..41: mol_type = other RNA
ttaatttctactattgtagatctccatcttgtcatcctgca

SEQ ID NO: 1238 - RNA, 41 nt, synthetic construct
  source 1..41: mol_type = other RNA
ataatttctactattgtagatctccatcttgtcatcctgca

SEQ ID NO: 1239 - RNA, 41 nt, synthetic construct
  source 1..41: mol_type = other RNA
ataatttctactgttgtagatctccatcttgtcatcctgca

SEQ ID NO: 1240 - RNA, 41 nt, synthetic construct
  source 1..41: mol_type = other RNA
ttaatttctactctcgtagatctccatcttgtcatcctgca

SEQ ID NO: 1241 - RNA, 41 nt, synthetic construct; identical to SEQ ID NO: 1235
  source 1..41: mol_type = other RNA

SEQ ID NO: 1242 - RNA, 41 nt, synthetic construct; identical to SEQ ID NO: 1230
  source 1..41: mol_type = other RNA

SEQ ID NO: 1243 - RNA, 41 nt, synthetic construct
  source 1..41: mol_type = other RNA
taaatttctactattgtagatctccatcttgtcatcctgca

SEQ ID NO: 1244 - RNA, 41 nt, synthetic construct; identical to SEQ ID NO: 1225
  source 1..41: mol_type = other RNA

SEQ ID NO: 1245 - RNA, 41 nt, synthetic construct; identical to SEQ ID NO: 1238
  source 1..41: mol_type = other RNA

SEQ ID NO: 1246 - RNA, 41 nt, synthetic construct; identical to SEQ ID NO: 1238
  source 1..41: mol_type = other RNA

SEQ ID NO: 1247 - RNA, 41 nt, synthetic construct; identical to SEQ ID NO: 1227
  source 1..41: mol_type = other RNA

SEQ ID NO: 1248 - RNA, 44 nt, synthetic construct
  source 1..44: mol_type = other RNA
gaaatttctactatcgtagattttgccttttcttctgcaatgcg

SEQ ID NO: 1249 - RNA, 44 nt, synthetic construct
  source 1..44: mol_type = other RNA
gaaatttctactatcgtagattctggtgaagaagttgaagctgt

SEQ ID NO: 1250 - RNA, 41 nt, synthetic construct; identical to SEQ ID NO: 1238
  source 1..41: mol_type = other RNA

SEQ ID NO: 1251 - RNA, 41 nt, synthetic construct; identical to SEQ ID NO: 1243
  source 1..41: mol_type = other RNA

SEQ ID NO: 1252 - RNA, 41 nt, synthetic construct
  source 1..41: mol_type = other RNA
tcaatttctactgttgtagatctccatcttgtcatcctgca

SEQ ID NO: 1253 - RNA, 41 nt, synthetic construct; identical to SEQ ID NO: 1227
  source 1..41: mol_type = other RNA

SEQ ID NO: 1254 - RNA, 41 nt, synthetic construct; identical to SEQ ID NO: 1243
  source 1..41: mol_type = other RNA

SEQ ID NO: 1255 - RNA, 41 nt, synthetic construct; identical to SEQ ID NO: 1239
  source 1..41: mol_type = other RNA

SEQ ID NO: 1256 - RNA, 41 nt, synthetic construct; identical to SEQ ID NO: 1239
  source 1..41: mol_type = other RNA

SEQ ID NO: 1257 - RNA, 44 nt, synthetic construct; identical to SEQ ID NO: 703
  source 1..44: mol_type = other RNA

SEQ ID NO: 1258 - RNA, 44 nt, synthetic construct; identical to SEQ ID NO: 704
  source 1..44: mol_type = other RNA

SEQ ID NO: 1259 - RNA, 44 nt, synthetic construct
  source 1..44: mol_type = other RNA
taatttctactaagtgtagatgtcggcatggccccattcgcacg

SEQ ID NO: 1260 - RNA, 44 nt, synthetic construct
  source 1..44: mol_type = other RNA
agaatttctactgttgtagatgtcggcatggccccattcgcacg

SEQ ID NO: 1261 - RNA, 44 nt, synthetic construct
  source 1..44: mol_type = other RNA
aaaatttctactcttgtagatgtcggcatggccccattcgcacg

SEQ ID NO: 1262 - RNA, 44 nt, synthetic construct
  source 1..44: mol_type = other RNA
aaaatttctactattgtagatgtcggcatggccccattcgcacg

SEQ ID NO: 1263 - RNA, 44 nt, synthetic construct; identical to SEQ ID NO: 1261
  source 1..44: mol_type = other RNA

SEQ ID NO: 1264 - RNA, 44 nt, synthetic construct
  source 1..44: mol_type = other RNA
tgaatttctactgttgtagatgtcggcatggccccattcgcacg

SEQ ID NO: 1265 - RNA, 44 nt, synthetic construct
  source 1..44: mol_type = other RNA
taaatttctactgttgtagatgtcggcatggccccattcgcacg

SEQ ID NO: 1266 - RNA, 44 nt, synthetic construct; identical to SEQ ID NO: 1262
  source 1..44: mol_type = other RNA

SEQ ID NO: 1267 - RNA, 44 nt, synthetic construct
  source 1..44: mol_type = other RNA
aaaatttctgctattgcagatgtcggcatggccccattcgcacg

SEQ ID NO: 1268 - RNA, 44 nt, synthetic construct
  source 1..44: mol_type = other RNA
taaatttctactattgtagatatggaatcccttctgcagcacct

SEQ ID NO: 1269 - RNA, 44 nt, synthetic construct; identical to SEQ ID NO: 705
  source 1..44: mol_type = other RNA

SEQ ID NO: 1270 - RNA, 44 nt, synthetic construct
  source 1..44: mol_type = other RNA
ataatttctactatcgtagatgtcggcatggccccattcgcacg

SEQ ID NO: 1271 - RNA, 44 nt, synthetic construct; identical to SEQ ID NO: 1265
  source 1..44: mol_type = other RNA

SEQ ID NO: 1272 - RNA, 44 nt, synthetic construct
  source 1..44: mol_type = other RNA
ttaatttctactattgtagatgtcggcatggccccattcgcacg

SEQ ID NO: 1273 - RNA, 44 nt, synthetic construct
  source 1..44: mol_type = other RNA
ataatttctactattgtagatgtcggcatggccccattcgcacg

SEQ ID NO: 1274 - RNA, 44 nt, synthetic construct
  source 1..44: mol_type = other RNA
ataatttctactgttgtagatgtcggcatggccccattcgcacg

SEQ ID NO: 1275 - RNA, 44 nt, synthetic construct
  source 1..44: mol_type = other RNA
ttaatttctactctcgtagatgtcggcatggccccattcgcacg

SEQ ID NO: 1276 - RNA, 44 nt, synthetic construct
  source 1..44: mol_type = other RNA
ataatttctactatcgtagattcctaaaaattacgaaaacgaaa

SEQ ID NO: 1277 - RNA, 44 nt, synthetic construct
  source 1..44: mol_type = other RNA
ataatttctactatcgtagataaaaacctcaacacagattctag

SEQ ID NO: 1278 - RNA, 44 nt, synthetic construct; identical to SEQ ID NO: 1265
  source 1..44: mol_type = other RNA

SEQ ID NO: 1279 - RNA, 44 nt, synthetic construct
  source 1..44: mol_type = other RNA
taaatttctactattgtagatgtcggcatggccccattcgcacg

SEQ ID NO: 1280 - RNA, 44 nt, synthetic construct; identical to SEQ ID NO: 1260
  source 1..44: mol_type = other RNA

SEQ ID NO: 1281 - RNA, 44 nt, synthetic construct; identical to SEQ ID NO: 1273
  source 1..44: mol_type = other RNA

SEQ ID NO: 1282 - RNA, 44 nt, synthetic construct; identical to SEQ ID NO: 1273
  source 1..44: mol_type = other RNA

SEQ ID NO: 1283 - RNA, 44 nt, synthetic construct; identical to SEQ ID NO: 1262
  source 1..44: mol_type = other RNA

SEQ ID NO: 1284 - RNA, 44 nt, synthetic construct
  source 1..44: mol_type = other RNA
gaaatttctactatcgtagataaataatctgggcttcagttcta

SEQ ID NO: 1285 - RNA, 44 nt, synthetic construct
  source 1..44: mol_type = other RNA
gaaatttctactatcgtagatctcacgtcacagtatgtctctgg

SEQ ID NO: 1286 - RNA, 44 nt, synthetic construct; identical to SEQ ID NO: 1273
  source 1..44: mol_type = other RNA

SEQ ID NO: 1287 - RNA, 44 nt, synthetic construct; identical to SEQ ID NO: 1279
  source 1..44: mol_type = other RNA

SEQ ID NO: 1288 - RNA, 44 nt, synthetic construct
  source 1..44: mol_type = other RNA
tcaatttctactgttgtagatgtcggcatggccccattcgcacg

SEQ ID NO: 1289 - RNA, 44 nt, synthetic construct; identical to SEQ ID NO: 1262
  source 1..44: mol_type = other RNA

SEQ ID NO: 1290 - RNA, 44 nt, synthetic construct
  source 1..44: mol_type = other RNA
taaatttctactattgtagattggcgttacttaattttgaaaaa

SEQ ID NO: 1291 - RNA, 44 nt, synthetic construct; identical to SEQ ID NO: 705
  source 1..44: mol_type = other RNA

SEQ ID NO: 1292 - RNA, 44 nt, synthetic construct; identical to SEQ ID NO: 1274
  source 1..44: mol_type = other RNA

SEQ ID NO: 1293 - RNA, 44 nt, synthetic construct; identical to SEQ ID NO: 1274
  source 1..44: mol_type = other RNA

SEQ ID NO: 1294 - RNA, 44 nt, synthetic construct
  source 1..44: mol_type = other RNA
aaaatttctgctattgcagattggcgttacttaattttgaaaaa

SEQ ID NO: 1295 - RNA, 44 nt, synthetic construct; identical to SEQ ID NO: 707
  source 1..44: mol_type = other RNA

SEQ ID NO: 1296 - RNA, 43 nt, synthetic construct
  source 1..43: mol_type = other RNA
taatttctactaagtgtagatgcggatgttccaatcagtacgc

SEQ ID NO: 1297 - RNA, 43 nt, synthetic construct
  source 1..43: mol_type = other RNA
agaatttctactgttgtagatgcggatgttccaatcagtacgc

SEQ ID NO: 1298 - RNA, 43 nt, synthetic construct
  source 1..43: mol_type = other RNA
aaaatttctactcttgtagatgcggatgttccaatcagtacgc

SEQ ID NO: 1299 - RNA, 43 nt, synthetic construct
  source 1..43: mol_type = other RNA
aaaatttctactattgtagatgcggatgttccaatcagtacgc

SEQ ID NO: 1300 - RNA, 43 nt, synthetic construct; identical to SEQ ID NO: 1298
  source 1..43: mol_type = other RNA

SEQ ID NO: 1301 - RNA, 43 nt, synthetic construct
  source 1..43: mol_type = other RNA
tgaatttctactgttgtagatgcggatgttccaatcagtacgc

SEQ ID NO: 1302 - RNA, 43 nt, synthetic construct
  source 1..43: mol_type = other RNA
taaatttctactgttgtagatgcggatgttccaatcagtacgc

SEQ ID NO: 1303 - RNA, 43 nt, synthetic construct; identical to SEQ ID NO: 1299
  source 1..43: mol_type = other RNA

SEQ ID NO: 1304 - RNA, 43 nt, synthetic construct
  source 1..43: mol_type = other RNA
aaaatttctgctattgcagatgcggatgttccaatcagtacgc

SEQ ID NO: 1305 - RNA, 43 nt, synthetic construct
  source 1..43: mol_type = other RNA
ataatttctactatcgtagatgcggatgttccaatcagtacgc

SEQ ID NO: 1306 - RNA, 43 nt, synthetic construct; identical to SEQ ID NO: 1302
  source 1..43: mol_type = other RNA

SEQ ID NO: 1307 - RNA, 43 nt, synthetic construct
  source 1..43: mol_type = other RNA
ttaatttctactattgtagatgcggatgttccaatcagtacgc

SEQ ID NO: 1308 - RNA, 43 nt, synthetic construct
  source 1..43: mol_type = other RNA
ataatttctactattgtagatgcggatgttccaatcagtacgc

SEQ ID NO: 1309 - RNA, 43 nt, synthetic construct
  source 1..43: mol_type = other RNA
ataatttctactgttgtagatgcggatgttccaatcagtacgc

SEQ ID NO: 1310 - RNA, 43 nt, synthetic construct
  source 1..43: mol_type = other RNA
ttaatttctactctcgtagatgcggatgttccaatcagtacgc

SEQ ID NO: 1311 - RNA, 43 nt, synthetic construct; identical to SEQ ID NO: 1302
  source 1..43: mol_type = other RNA

SEQ ID NO: 1312 - RNA, 43 nt, synthetic construct
  source 1..43: mol_type = other RNA
taaatttctactattgtagatgcggatgttccaatcagtacgc

SEQ ID NO: 1313 - RNA, 43 nt, synthetic construct; identical to SEQ ID NO: 1297
  source 1..43: mol_type = other RNA

SEQ ID NO: 1314 - RNA, 43 nt, synthetic construct; identical to SEQ ID NO: 1308
  source 1..43: mol_type = other RNA

SEQ ID NO: 1315 - RNA, 43 nt, synthetic construct; identical to SEQ ID NO: 1308
  source 1..43: mol_type = other RNA

SEQ ID NO: 1316 - RNA, 43 nt, synthetic construct; identical to SEQ ID NO: 1299
  source 1..43: mol_type = other RNA

SEQ ID NO: 1317 - RNA, 43 nt, synthetic construct; identical to SEQ ID NO: 1308
  source 1..43: mol_type = other RNA

SEQ ID NO: 1318 - RNA, 43 nt, synthetic construct; identical to SEQ ID NO: 1312
  source 1..43: mol_type = other RNA

SEQ ID NO: 1319 - RNA, 43 nt, synthetic construct
  source 1..43: mol_type = other RNA
tcaatttctactgttgtagatgcggatgttccaatcagtacgc

SEQ ID NO: 1320 - RNA, 43 nt, synthetic construct; identical to SEQ ID NO: 1299
  source 1..43: mol_type = other RNA

SEQ ID NO: 1321 - RNA, 43 nt, synthetic construct; identical to SEQ ID NO: 1309
  source 1..43: mol_type = other RNA

SEQ ID NO: 1322 - RNA, 43 nt, synthetic construct; identical to SEQ ID NO: 1309
  source 1..43: mol_type = other RNA

SEQ ID NO: 1323 - DNA, 19 bp, synthetic construct
  source 1..19: mol_type = other DNA
gccaaagcccgagagagtg

SEQ ID NO: 1324 - DNA, 20 bp, synthetic construct
  source 1..20: mol_type = other DNA
cctcacacaacagcttcatg

SEQ ID NO: 1325 - DNA, 22 bp, synthetic construct
  source 1..22: mol_type = other DNA
catcaccaacccacagccaagg

SEQ ID NO: 1326 - DNA, 25 bp, synthetic construct
  source 1..25: mol_type = other DNA
ccagcacaacttactcgcacttgac

SEQ ID NO: 1327 - DNA, 20 bp, synthetic construct
  source 1..20: mol_type = other DNA
agtccaaggaatgcagtagg

SEQ ID NO: 1328 - DNA, 20 bp, synthetic construct
  source 1..20: mol_type = other DNA
ggcacagttcctgtatcagt

SEQ ID NO: 1329 - DNA, 22 bp, synthetic construct
  source 1..22: mol_type = other DNA
gccctacatctgctctccctcc

SEQ ID NO: 1330 - DNA, 20 bp, synthetic construct
  source 1..20: mol_type = other DNA
gggccgggaaagagttgctg

SEQ ID NO: 1331 - DNA, 23 bp, synthetic construct
  source 1..23: mol_type = other DNA
gcgacataggaccttctcctccc

SEQ ID NO: 1332 - DNA, 22 bp, synthetic construct
  source 1..22: mol_type = other DNA
ggagggagagcagatgtagggc

SEQ ID NO: 1333 - DNA, 719 bp, synthetic construct
  source 1..719: mol_type = other DNA
gccaaagcccgagagagtgcctcaggtatggtggggtgggccaggcttcctctggggcctgactgccctctgggggtacatgtgggggcagttgctggccaccgttttgggctctgggactcaggcgggtcacctacccacgttcgtggccccatctttctcaaggggctgctgtgaggattgagtgagttgcacgtgtcaagtgcttagagcaggcgtgctgcacacagcaggcctttggtcaggttggctgctgggctggccctggggccgtttccctcactcctgctcggtgaatttggctcagcaggcacctgcctcagctgctcacttgagcctctgggtctagaaccctctggggaccgtttgaggagtgttcagtctccgtgaacgttcccttagcactctgccacttattgggtcagctgttaacatcagtacgttaatgtttcctgatggtccatgtctgttactcgcctgtcaagtggcgtgacaccgggcgtgttccccagagtgacttttccttttatttcccttcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgagg

SEQ ID NO: 1334 - DNA, 601 bp, synthetic construct
  source 1..601: mol_type = other DNA
catcaccaacccacagccaaggcggcgctggctttttttttttttttaatctttaacaatttgaatatttgtttttacaaaggtgcattttttaatagggcttggggagtcccagaggtatccagcagaggggagaagaaagagagatgtagggctagaggggtgaggctgaaacagtgacctgtcttggttttcgctccgaaggtaaaagaaatcattgagtcccccgccttcagaagagggtgcattttcaggaggaagcgatggcttcagacagcatatttgagtcatttccttcgtacccacagtgcttcatgagaggtgagtacatgctggtcttgtaatatctacttttgctcagctttgcctgtaatgaaatggcagcttgtttcacctcggtgcagagatgcctcggtgcctgccagttccctgtcttgtttgtgagaggaattcaaactgaggcatatgattacaagtctattggattacttactaatcagatggaagctcttcagaaatgttttaataaatacttagttatgctgttggagtgttcagtcggtgcgtgagaactttgtcaagtgcgagtaagttgtgctgg

SEQ ID NO: 1335 - DNA, 597 bp, synthetic construct
  source 1..597: mol_type = other DNA
agtccaaggaatgcagtaggcaattagcagcaaaatatgcctgataaaaaacactcactttcttattgatatagtaggggtccaggtcctccaggggctctgacaccatctctggaggaatgtctccataaataaatggaaggttctttccagcttccaagtcactatttggctttgggccattttcgtcgtcatcttttttgtctggtttgggattctttgccttttcttctgcaatgcgtctttcaatagccgcaagagattctctggtgaagaagttgaagctgtcaggtcctggtggtacaagcactgtttgctccatcttgtcatcctgcacattttaattaccatttattctgcatatgaaattcctaaaataaaaggaatacagatattttaaagagtggactaagagatgttaatataaataaattcttgtcatgaaacatgagctagaggatttaaagtctgttttctccttaaattgaaaggtgatttctaaagaaaaaattttaacacaaatggtttctgtgttgagtttagttaagcatcacttatttattaattcttgtgctttactgatacaggaactgtgcc

SEQ ID NO: 1336 - DNA, 591 bp, synthetic construct
  source 1..591: mol_type = other DNA
gccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggccc

SEQ ID NO: 1337 - DNA, 575 bp, synthetic construct
  source 1..575: mol_type = other DNA
gcgacataggaccttctcctccctactctcttgtcacggtttttatttaatcaaacatttattattgttcgatgctcttaaatgccatttccttcagctgattatttgtatgacagaagagtcaattaagctattttgtcctaaaaattacgaaaacgaaatgtacaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttctacttaaggatatttccaaagcgaaaggaagcgcggagacgttcatgactggcatcatctcgcacgtggttccggaaattctcggtaggatgccctacatctgctctccctcc

SEQ ID NO: 1338 - RNA, 81 nt, synthetic construct
  source 1..81: mol_type = other RNA
ggaaatcgcaaaatttgctcttcgcgttagatttcttttagttttctcgcaactagcaagctttttgttctcgccgccgcc

SEQ ID NO: 1339 - RNA, 81 nt, synthetic construct; identical to SEQ ID NO: 1338
  source 1..81: mol_type = other RNA

SEQ ID NO: 1340 - RNA, 81 nt, synthetic construct
  source 1..81: mol_type = other RNA
ggaaatcgcaaaattttcttttcgcgttagatttcttttagttttctttcaactagcaagctttttgttctcgccgccgcc

SEQ ID NO: 1341 - RNA, 83 nt, synthetic construct
  source 1..83: mol_type = other RNA
ggaaatcgcaaaatttttgctctttttcgcgttagatttcttttagttttctykcaactagcaagctttttgttctcgccrcc

SEQ ID NO: 1342 - RNA, 203 nt, synthetic construct
  source 1..203: mol_type = other RNA
ggaaatccccacaaccgcctcatatccaggctcaagaatagagctcagtgttttgttgtttaatcattccgacgtgttttgcgatattcgcgcaaagcagccagtcgcgcgcttgcttttaagtagagttgtttttccacccgtttgccaggcatctttaatttaacatatttttatttttcaggctaacctacgccgccacc

SEQ ID NO: 1343 - RNA, 76 nt, synthetic construct
  source 1..76: mol_type = other RNA
ggaaataagagagaaaagaagagtaagaagaaatataagatctccctgagcttcagggagccccggcgccgccacc

SEQ ID NO: 1344 - RNA, 89 nt, synthetic construct
  source 1..89: mol_type = other RNA
ggaaaccccccacccccgtaagagagaaaagaagagtaagaagaaatataagatctccctgagcttcagggagccccggcgccgccacc

SEQ ID NO: 1345 - RNA, 59 nt, synthetic construct
  source 1..59: mol_type = other RNA
ggagaacttccgcttccgttggcgcaagcgctttcattttttctgctaccgtgactaag

SEQ ID NO: 1346 - RNA, 46 nt, synthetic construct
  source 1..46: mol_type = other RNA
ggaaataagagagaaaagaagagtaagaagaaatataagagccacc

SEQ ID NO: 1347 - RNA, 56 nt, synthetic construct
  source 1..56: mol_type = other RNA
ggaaataagagagaaaagaagagtaagaagaaatataagaccccggcgccgccacc

SEQ ID NO: 1348 - RNA, 79 nt, synthetic construct
  source 1..79: mol_type = other RNA
ggaaactttatttagtgttactttattttctgtttatttgtgtttcttcagtgggtttgttctaatttccttggccgcc

SEQ ID NO: 1349 - RNA, 79 nt, synthetic construct
  source 1..79: mol_type = other RNA
ggaaaatctgtattaggttggcgtgttctttggtcggttgttagtattgttgttgattcgtttgtggtcggttgccgcc

SEQ ID NO: 1350 - RNA, 79 nt, synthetic construct
  source 1..79: mol_type = other RNA
ggaaaattattaacatcttggtattctcgataaccattcgttggattttattgtattcgtagtttgggttcctgccgcc

SEQ ID NO: 1351 - RNA, 79 nt, synthetic construct
  source 1..79: mol_type = other RNA
ggaaattattattatttctagctacaatttatcattgtattattttagctattcatcattatttacttggtgatcaaca

SEQ ID NO: 1352 - RNA, 79 nt, synthetic construct
  source 1..79: mol_type = other RNA
ggaaataggttgttaaccaagttcaagcctaataagcttggattctggtgacttgcttcaccgttggcgggcaccgatc

SEQ ID NO: 1353 - RNA, 74 nt, synthetic construct
  source 1..74: mol_type = other RNA
ggaaatcgtagagagtcgtacttagtacatatcgactatcggtggacaccatcaagattataaaccaggccaga

SEQ ID NO: 1354 - RNA, 79 nt, synthetic construct
  source 1..79: mol_type = other RNA
ggaaacccgcccaagcgaccccaacatatcagcagttgcccaatcccaactcccaacacaatccccaagcaacgccgcc

SEQ ID NO: 1355 - RNA, 79 nt, synthetic construct
  source 1..79: mol_type = other RNA
ggaaagcgattgaaggcgtcttttcaactactcgattaaggttgggtatcgtcgtgggacttggaaatttgttgtttcc

SEQ ID NO: 1356 - RNA, 79 nt, synthetic construct
  source 1..79: mol_type = other RNA
ggaaactaatcgaaataaaagagccccgtactcttttatttctattaggttaggagccttagcatttgtatcttaggta

SEQ ID NO: 1357 - RNA, 79 nt, synthetic construct
  source 1..79: mol_type = other RNA
ggaaatgtgatttccagcaacttcttttgaatatattgaattcctaattcaaagcgaacaaatctacaagccatatacc

SEQ ID NO: 1358 - RNA, 74 nt, synthetic construct
  source 1..74: mol_type = other RNA
ggaaatcgtagagagtcgtacttacgtggtcgccattgcatagcgcgcgaaagcaacaggaacaagaacgcgcc

SEQ ID NO: 1359 - RNA, 74 nt, synthetic construct
  source 1..74: mol_type = other RNA
ggaaatcgtagagagtcgtacttagaataaacagagtcgggtcgacttgtctctgatactacgacgtcacaatc

SEQ ID NO: 1360 - RNA, 79 nt, synthetic construct
  source 1..79: mol_type = other RNA
ggaaaatttgccttcggagttgcgtatcctgaactgcccagcctcctgatatacaactgttccgcttattcgggccgcc

SEQ ID NO: 1361 - RNA, 79 nt, synthetic construct
  source 1..79: mol_type = other RNA
ggaaatctgagcaggaatcctttgtgcattgaagactttagattcctctctgcggtagacgtgcacttataagtatttg

SEQ ID NO: 1362 - RNA, 79 nt, synthetic construct
  source 1..79: mol_type = other RNA
ggaaagcgattgaaggcgtcttttcaactactcgattaaggttgggtatcgtcgtgggacttggaaatttgttgccacc

SEQ ID NO: 1363 - RNA, 79 nt, synthetic construct
  source 1..79: mol_type = other RNA
ggaaaattttagcctggaacgttagataactgtcctgttgtctttatatacttggtccccaagtagtttgtcttccaaa

SEQ ID NO: 1364 - RNA, 104 nt, synthetic construct
  source 1..104: mol_type = other RNA
ggaaatttttttttgatattataagagtttttttttgatattaagaaaatttttttttgatattagaagagtaagaagaaatataagaccccggcgccgccacc

SEQ ID NO: 1365 - RNA, 57 nt, synthetic construct
  source 1..57: mol_type = other RNA
ggaaataagagagaaaagaagagtaagaagaaatataagagccaaaaaaaaaaaacc

SEQ ID NO: 1366 - RNA, 76 nt, synthetic construct
  source 1..76: mol_type = other RNA
ggaaatctccctgagcttcagggagtaagagagaaaagaagagtaagaagaaatataagaccccggcgccgccacc

SEQ ID NO: 1367-1372 - skipped (6 entries)

SEQ ID NO: 1373 - RNA, 15 nt, synthetic construct
  source 1..15: mol_type = other RNA
taagcccctccgggg

SEQ ID NO: 1374 - RNA, 15 nt, synthetic construct
  source 1..15: mol_type = other RNA
taaagctccccgggg

SEQ ID NO: 1375-1381 - skipped (7 entries)

SEQ ID NO: 1382 - RNA, 47 nt, synthetic construct
  source 1..47: mol_type = other RNA
gggaaataagagagaaaagaagagtaagaagaaatataagagccacc

SEQ ID NO: 1383 - DNA, 47 bp, synthetic construct
  source 1..47: mol_type = other DNA
gggaaataagagagaaaagaagagtaagaagaaatataagagccacc

SEQ ID NO: 1384 - skipped

SEQ ID NO: 1385 - protein, 1228 aa, synthetic construct
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1386 - protein, 41 aa, synthetic construct
YSLSKTLRFKAIPVGKTQENIDNKRLLVEDEKRAEDYKGVK

SEQ ID NO: 1387 - protein, 46 aa, synthetic construct
VNSFNGFTTAFTGFFDNRENMFSEEAKSTSIAFRCINENLTRYISN

SEQ ID NO: 1388 - protein, 15 aa, synthetic construct
FNFVLTQEGIDVYNA

SEQ ID NO: 1389 - protein, 8 aa, synthetic construct
FKPLYKQV

SEQ ID NO: 1390 - protein, 24 aa, synthetic construct
YDAIRNYVTQKPYSKDKFKLYFQN

SEQ ID NO: 1391 - skipped

SEQ ID NO: 1392 - protein, 10 aa, synthetic construct
LYMFQIYNKD

SEQ ID NO: 1393 - protein, 29 aa, synthetic construct
LHTMYFKLLFDENNHGQIRLSGGAELFMR

SEQ ID NO: 1394 - protein, 8 aa, synthetic construct
LHIPIAIN

SEQ ID NO: 1395 - protein, 48 aa, synthetic construct
IGIDRGERNLLYIVVVDGKGNIVEQYSLNEIINNFNGIRIKTDYHSLL

SEQ ID NO: 1396 - protein, 46 aa, synthetic construct
RFEARQNWTSIENIKELKAGYISQVVHKICELVEKYDAVIALEDLN

SEQ ID NO: 1397 - protein, 39 aa, synthetic construct
EKQVYQKFEKMLIDKLNYMVDKKSNPCATGGALKGYQIT

SEQ ID NO: 1398 - protein, 46 aa, synthetic construct
QNGFIFYIPAWLTSKIDPSTGFVNLLKTKYTSIADSKKFISSFDRI

SEQ ID NO: 1399 - skipped

SEQ ID NO: 1400 - protein, 28 aa, synthetic construct
FMALMSLMLQMRNSITGRTDVDFLISPV

SEQ ID NO: 1401 - protein, 14 aa, synthetic construct
NADANGAYNIARKV

SEQ ID NO: 1402 - protein, 9 aa, synthetic construct
ISNKEWLEY

SEQ ID NO: 1403 - protein, 30 aa, synthetic construct
GGSGGSGGSGGSGGSGGSGGSGGSGGSGGS

SEQ ID NO: 1404 - protein, 33 aa, synthetic construct
GGSGGSGGSGGSGGSGGSGGSGGSGGSGGSGGS

SEQ ID NO: 1405 - protein, 36 aa, synthetic construct
GGSGGSGGSGGSGGSGGSGGSGGSGGSGGSGGSGGS

SEQ ID NO: 1406 - protein, 39 aa, synthetic construct
GGSGGSGGSGGSGGSGGSGGSGGSGGSGGSGGSGGSGGS

SEQ ID NO: 1407 - protein, 42 aa, synthetic construct
GGSGGSGGSGGSGGSGGSGGSGGSGGSGGSGGSGGSGGSGGS

SEQ ID NO: 1408 - protein, 45 aa, synthetic construct
GGSGGSGGSGGSGGSGGSGGSGGSGGSGGSGGSGGSGGSGGSGGS

SEQ ID NO: 1409 - protein, 6 aa, synthetic construct
GSGGSG

SEQ ID NO: 1410 - protein, 9 aa, synthetic construct
GSGGSGGSG

SEQ ID NO: 1411 - protein, 12 aa, synthetic construct
GSGGSGGSGGSG

SEQ ID NO: 1412 - protein, 15 aa, synthetic construct
GSGGSGGSGGSGGSG

SEQ ID NO: 1413 - protein, 18 aa, synthetic construct
GSGGSGGSGGSGGSGGSG

SEQ ID NO: 1414 - protein, 24 aa, synthetic construct
GSGGSGGSGGSGGSGGSGGSGGSG

SEQ ID NO: 1415 - protein, 27 aa, synthetic construct
GSGGSGGSGGSGGSGGSGGSGGSGGSG

SEQ ID NO: 1416 - protein, 30 aa, synthetic construct
GSGGSGGSGGSGGSGGSGGSGGSGGSGGSG

SEQ ID NO: 1417 - protein, 33 aa, synthetic construct
GSGGSGGSGGSGGSGGSGGSGGSGGSGGSGGSG

SEQ ID NO: 1418 - protein, 36 aa, synthetic construct
GSGGSGGSGGSGGSGGSGGSGGSGGSGGSGGSGGSG

SEQ ID NO: 1419 - protein, 39 aa, synthetic construct
GSGGSGGSGGSGGSGGSGGSGGSGGSGGSGGSGGSGGSG

SEQ ID NO: 1420 - protein, 42 aa, synthetic construct
GSGGSGGSGGSGGSGGSGGSGGSGGSGGSGGSGGSGGSGGSG

SEQ ID NO: 1421 - protein, 45 aa, synthetic construct
GSGGSGGSGGSGGSGGSGGSGGSGGSGGSGGSGGSGGSGGSGGSG

SEQ ID NO: 1422 - protein, 4 aa, synthetic construct
GGGS

SEQ ID NO: 1423 - protein, 8 aa, synthetic construct
GGGSGGGS

SEQ ID NO: 1424 - protein, 12 aa, synthetic construct
GGGSGGGSGGGS

SEQ ID NO: 1425 - protein, 16 aa, synthetic construct
GGGSGGGSGGGSGGGS

SEQ ID NO: 1426 - protein, 20 aa, synthetic construct
GGGSGGGSGGGSGGGSGGGS

SEQ ID NO: 1427 - protein, 24 aa, synthetic construct
GGGSGGGSGGGSGGGSGGGSGGGS

SEQ ID NO: 1428 - protein, 28 aa, synthetic construct
GGGSGGGSGGGSGGGSGGGSGGGSGGGS

SEQ ID NO: 1429 - protein, 32 aa, synthetic construct
GGGSGGGSGGGSGGGSGGGSGGGSGGGSGGGS

SEQ ID NO: 1430 - protein, 36 aa, synthetic construct
GGGSGGGSGGGSGGGSGGGSGGGSGGGSGGGSGGGS

SEQ ID NO: 1431 - protein, 40 aa, synthetic construct
GGGSGGGSGGGSGGGSGGGSGGGSGGGSGGGSGGGSGGGS

SEQ ID NO: 1432 - protein, 44 aa, synthetic construct
GGGSGGGSGGGSGGGSGGGSGGGSGGGSGGGSGGGSGGGSGGGS

SEQ ID NO: 1433 - protein, 48 aa, synthetic construct
GGGSGGGSGGGSGGGSGGGSGGGSGGGSGGGSGGGSGGGSGGGSGGGS

SEQ ID NO: 1434 - protein, 52 aa, synthetic construct
GGGSGGGSGGGSGGGSGGGSGGGSGGGSGGGSGGGSGGGSGGGSGGGSGGGS

SEQ ID NO: 1435 - protein, 56 aa, synthetic construct
GGGSGGGSGGGSGGGSGGGSGGGSGGGSGGGSGGGSGGGSGGGSGGGSGGGSGGGS

SEQ ID NO: 1436 - protein, 60 aa, synthetic construct
GGGSGGGSGGGSGGGSGGGSGGGSGGGSGGGSGGGSGGGSGGGSGGGSGGGSGGGSGGGS

SEQ ID NO: 1437 - protein, 5 aa, synthetic construct
GGGGS

SEQ ID NO: 1438 - protein, 10 aa, synthetic construct
GGGGSGGGGS

SEQ ID NO: 1439 - protein, 15 aa, synthetic construct
GGGGSGGGGSGGGGS

SEQ ID NO: 1440 - protein, 20 aa, synthetic construct
GGGGSGGGGSGGGGSGGGGS

SEQ ID NO: 1441 - protein, 25 aa, synthetic construct
GGGGSGGGGSGGGGSGGGGSGGGGS

SEQ ID NO: 1442 - protein, 30 aa, synthetic construct
GGGGSGGGGSGGGGSGGGGSGGGGSGGGGS

SEQ ID NO: 1443 - protein, 35 aa, synthetic construct
GGGGSGGGGSGGGGSGGGGSGGGGSGGGGSGGGGS

SEQ ID NO: 1444 - protein, 40 aa, synthetic construct
GGGGSGGGGSGGGGSGGGGSGGGGSGGGGSGGGGSGGGGS

SEQ ID NO: 1445 - protein, 45 aa, synthetic construct
GGGGSGGGGSGGGGSGGGGSGGGGSGGGGSGGGGSGGGGSGGGGS

SEQ ID NO: 1446 - protein, 50 aa, synthetic construct
GGGGSGGGGSGGGGSGGGGSGGGGSGGGGSGGGGSGGGGSGGGGSGGGGS

SEQ ID NO: 1447 - protein, 55 aa, synthetic construct
GGGGSGGGGSGGGGSGGGGSGGGGSGGGGSGGGGSGGGGSGGGGSGGGGSGGGGS

SEQ ID NO: 1448 - protein, 60 aa, synthetic construct
GGGGSGGGGSGGGGSGGGGSGGGGSGGGGSGGGGSGGGGSGGGGSGGGGSGGGGSGGGGS

SEQ ID NO: 1449 - protein, 65 aa, synthetic construct
GGGGSGGGGSGGGGSGGGGSGGGGSGGGGSGGGGSGGGGSGGGGSGGGGSGGGGSGGGGSGGGGS

SEQ ID NO: 1450 - protein, 70 aa, synthetic construct
GGGGSGGGGSGGGGSGGGGSGGGGSGGGGSGGGGSGGGGSGGGGSGGGGSGGGGSGGGGSGGGGSGGGGS

SEQ ID NO: 1451 - protein, 75 aa, synthetic construct
GGGGSGGGGSGGGGSGGGGSGGGGSGGGGSGGGGSGGGGSGGGGSGGGGSGGGGSGGGGSGGGGSGGGGSGGGGS

SEQ ID NO: 1452 - protein, 32 aa, synthetic construct
LEPGEKPYKCPECGKSFSQSGALTRHQRTHTR

SEQ ID NO: 1453 - protein, 48 aa, synthetic construct
TCGGGATCTGAGACGCCTGGGACCTCGGAATCGGCTACGCCCGAAAGT

SEQ ID NO: 1454 - protein, 64 aa, synthetic construct
LEPGEKPYKCPECGKSFSQSGALTRHQRTHTRLEPGEKPYKCPECGKSFSQSGALTRHQRTHTR

SEQ ID NO: 1455 - protein, 96 aa, synthetic construct
LEPGEKPYKCPECGKSFSQSGALTRHQRTHTRLEPGEKPYKCPECGKSFSQSGALTRHQRTHTRLEPGEKPYKCPECGKSFSQSGALTRHQRTHTR

SEQ ID NO: 1456 - protein, 20 aa, synthetic construct
PKKKRKVEASSPKKRKVEAS

SEQ ID NO: 1457 - protein, 16 aa, synthetic construct
KRPAATKKAGQAKKKK

SEQ ID NO: 1458 - protein, 9 aa, synthetic construct
PAAKRVKLD

SEQ ID NO: 1459 - protein, 11 aa, synthetic construct
RQRRNELKRSP

SEQ ID NO: 1460 - protein, 38 aa, synthetic construct
NQSSNFGPMKGGNFGGRSSGPYGGGGQYFAKPRNQGGY

SEQ ID NO: 1461 - protein, 42 aa, synthetic construct
RMRIZFKNKGKDTAELRRRRVEVSVELRKAKKDEQILKRRNV

SEQ ID NO: 1462 - protein, 8 aa, synthetic construct
PPKKARED

SEQ ID NO: 1463 - protein, 8 aa, Homo sapiens
PQPKKKPL

SEQ ID NO: 1464 - protein, 12 aa, Mus sp.
SALIKKKKKMAP

SEQ ID NO: 1465 - protein, 5 aa, unidentified
  source 1..5: note = Influenza virus NS 1
DRLRR

SEQ ID NO: 1466 - protein, 7 aa, unidentified
  source 1..7: note = Influenza virus NS 1
PKQKKRK

SEQ ID NO: 1467 - protein, 10 aa, unidentified
  source 1..10: note = Hepatitis virus
RKLKKKIKKL

SEQ ID NO: 1468 - protein, 10 aa, Mus sp.
REKKKFLKRR

SEQ ID NO: 1469 - protein, 20 aa, Homo sapiens
KRKGDEVDGVDEVAKKKSKK

SEQ ID NO: 1470 - protein, 17 aa, Homo sapiens
RICLQAGMNLEARITII

SEQ ID NO: 1471 - skipped

SEQ ID NO: 1472 - DNA, 11 bp, synthetic construct
  source 1..11: mol_type = other DNA
gtcaatggacc

SEQ ID NO: 1473 - DNA, 11 bp, synthetic construct
  source 1..11: mol_type = other DNA
ggtccattgac

SEQ ID NO: 1474 - skipped

SEQ ID NO: 1475 - DNA, 50 bp, synthetic construct
  source 1..50: mol_type = other DNA
attttcaggaggaagcgatggcttcagacagcatatttgagtcatttcct

SEQ ID NO: 1476 - DNA, 34 bp, synthetic construct
  source 1..34: mol_type = other DNA
attttcaggaggaagcatatttgagtcatttcct

SEQ ID NO: 1477 - DNA, 45 bp, synthetic construct
  source 1..45: mol_type = other DNA
attttcaggaggaagcgatcagacagcatatttgagtcatttcct

SEQ ID NO: 1478 - DNA, 46 bp, synthetic construct
  source 1..46: mol_type = other DNA
attttcaggaggaagcgattcagacagcatatttgagtcatttcct

SEQ ID NO: 1479 - DNA, 47 bp, synthetic construct
  source 1..47: mol_type = other DNA
attttcaggaggaagcgacttcagacagcatatttgagtcatttcct

SEQ ID NO: 1480 - DNA, 43 bp, synthetic construct
  source 1..43: mol_type = other DNA
attttcaggaggaagcgatggcagcatatttgagtcatttcct

SEQ ID NO: 1481 - DNA, 49 bp, synthetic construct
  source 1..49: mol_type = other DNA
attttcaggaggaagcgatgcttcagacagcatatttgagtcatttcct

SEQ ID NO: 1482 - DNA, 47 bp, synthetic construct
  source 1..47: mol_type = other DNA
attttcaggaggaagcgatggcagacagcatatttgagtcatttcct

SEQ ID NO: 1483 - DNA, 49 bp, synthetic construct
  source 1..49: mol_type = other DNA
attttcaggaggaagcgatggctcagacagcatatttgagtcatttcct

SEQ ID NO: 1484 - DNA, 35 bp, synthetic construct
  source 1..35: mol_type = other DNA
attttcaggaggaagcgatatttgagtcatttcct

SEQ ID NO: 1485 - DNA, 46 bp, synthetic construct
  source 1..46: mol_type = other DNA
attttcaggaggaagcgatggcttcagcatatttgagtcatttcct

SEQ ID NO: 1486 - DNA, 47 bp, synthetic construct
  source 1..47: mol_type = other DNA
attttcaggaggaagcgatgtcagacagcatatttgagtcatttcct

SEQ ID NO: 1487 - DNA, 51 bp, synthetic construct
  source 1..51: mol_type = other DNA
tttgctccatcttgtcatcctgcacattttaattaccatttattctgcata

SEQ ID NO: 1488 - DNA, 48 bp, synthetic construct
  source 1..48: mol_type = other DNA
tttgctccatcttgtcatgcacattttaattaccatttattctgcata

SEQ ID NO: 1489 - DNA, 47 bp, synthetic construct
  source 1..47: mol_type = other DNA
tttgctccatcttgtcatcacattttaattaccatttattctgcata

SEQ ID NO: 1490 - DNA, 45 bp, synthetic construct
  source 1..45: mol_type = other DNA
tttgctccatcttgtcatcattttaattaccatttattctgcata

SEQ ID NO: 1491 - DNA, 40 bp, synthetic construct
  source 1..40: mol_type = other DNA
tttgctccatcttgtcattaattaccatttattctgcata

SEQ ID NO: 1492 - DNA, 30 bp, synthetic construct
  source 1..30: mol_type = other DNA
tttgctccatcttgtcatttattctgcata

SEQ ID NO: 1493 - DNA, 50 bp, synthetic construct
  source 1..50: mol_type = other DNA
tttgctccatcttgtcatcctgcacatttaattaccatttattctgcata

SEQ ID NO: 1494 - DNA, 50 bp, synthetic construct
  source 1..50: mol_type = other DNA
tttgctccatcttgtcatcctgcacattttaattaccatttatttgcata

SEQ ID NO: 1495 - DNA, 50 bp, synthetic construct
  source 1..50: mol_type = other DNA
tttgctccatcttgtcatcctgcacattttaattaccatttattctgcaa

SEQ ID NO: 1496 - DNA, 50 bp, synthetic construct
  source 1..50: mol_type = other DNA
tttgctccatcttgtcatcctgcacattttaattaccatttattcgcata

SEQ ID NO: 1497 - DNA, 50 bp, synthetic construct
  source 1..50: mol_type = other DNA
tttgctccatcttgtcatcctgcacattttaattaccatttattctgata

SEQ ID NO: 1498 - DNA, 41 bp, synthetic construct
  source 1..41: mol_type = other DNA
tttgctccatcttgtcatttaattaccatttattctgcata

SEQ ID NO: 1499 - DNA, 50 bp, synthetic construct
  source 1..50: mol_type = other DNA
tttgctccatcttgtcatctgcacattttaattaccatttattctgcata

SEQ ID NO: 1500 - DNA, 50 bp, synthetic construct
  source 1..50: mol_type = other DNA
tttccctcactcctgctcggtgaatttggctcagcaggcacctgcctcag

SEQ ID NO: 1501 - DNA, 36 bp, synthetic construct
  source 1..36: mol_type = other DNA
tttccctcactcctgctcagcaggcacctgcctcag

SEQ ID NO: 1502 - DNA, 21 bp, synthetic construct
  source 1..21: mol_type = other DNA
tttccctcactcctgcctcag

SEQ ID NO: 1503 - DNA, 18 bp, synthetic construct
  source 1..18: mol_type = other DNA
tttccctcactcctgctc

SEQ ID NO: 1504 - DNA, 21 bp, synthetic construct
  source 1..21: mol_type = other DNA
tttccctcacacctgcctcag

SEQ ID NO: 1505 - DNA, 20 bp, synthetic construct
  source 1..20: mol_type = other DNA
tttccctcactcctgctcag

SEQ ID NO: 1506 - DNA, 48 bp, synthetic construct
  source 1..48: mol_type = other DNA
tttccctcactcctgctcggaatttggctcagcaggcacctgcctcag

SEQ ID NO: 1507 - DNA, 18 bp, synthetic construct
  source 1..18: mol_type = other DNA
tttggtgcagcaggacgc

SEQ ID NO: 1508 - DNA, 50 bp, synthetic construct
  source 1..50: mol_type = other DNA
tttggtcggcatggccccattcgcacggctctggagcggcggctacacaa

SEQ ID NO: 1509 - DNA, 23 bp, synthetic construct
  source 1..23: mol_type = other DNA
ttcaggtggggcctgggccagtg

SEQ ID NO: 1510 - DNA, 50 bp, synthetic construct
  source 1..50: mol_type = other DNA
tttggtcggcatggttccattcgcacggctctggagcggcggctgcacaa

SEQ ID NO: 1511 - DNA, 50 bp, synthetic construct
  source 1..50: mol_type = other DNA
tttggtcggcatggccccattcgcacggctctggagcggcggcttcacaa

SEQ ID NO: 1512 - DNA, 36 bp, synthetic construct
  source 1..36: mol_type = other DNA
tttggtcggcatggctctggagcggcggctgcacaa

SEQ ID NO: 1513 - DNA, 47 bp, synthetic construct
  source 1..47: mol_type = other DNA
tttggtcggcatggccccagcacggctctggagcggcggctgcacaa

SEQ ID NO: 1514 - DNA, 56 bp, synthetic construct
  source 1..56: mol_type = other DNA
aagaaccggccaagtcaaaagtgtagccaatcccgttgggagaggggaggtctcgg

SEQ ID NO: 1515 - DNA, 35 bp, synthetic construct
  source 1..35: mol_type = other DNA
atctatctccctgagctcacaggctcaggaggagc

SEQ ID NO: 1516 - DNA, 31 bp, synthetic construct
  source 1..31: mol_type = other DNA
tttggtcggctctggagcggcggctgcacaa

SEQ ID NO: 1517 - DNA, 46 bp, synthetic construct
  source 1..46: mol_type = other DNA
tttggtcggcatggccccgcacggctctggagcggcggctgcacaa

SEQ ID NO: 1518 - DNA, 48 bp, synthetic construct
  source 1..48: mol_type = other DNA
tttggtcggcatggccccacgcacggctctggagcggcggctgcacaa

SEQ ID NO: 1519 - DNA, 50 bp, synthetic construct
  source 1..50: mol_type = other DNA
tttggtcggcatggccccattcgcacggctctggagcggcggctgcacaa

SEQ ID NO: 1520 - DNA, 46 bp, synthetic construct
  source 1..46: mol_type = other DNA
tttggtcggcatggccccattcggctctggagcggcggctgcacaa

SEQ ID NO: 1521 - DNA, 50 bp, synthetic construct
  source 1..50: mol_type = other DNA
tttcgcggatgttccaatcagtacgcagagagtcgccgtctccaaggtga

SEQ ID NO: 1522 - DNA, 22 bp, synthetic construct
  source 1..22: mol_type = other DNA
tttcgcggatgttccaaggtga

SEQ ID NO: 1523 - DNA, 30 bp, synthetic construct
  source 1..30: mol_type = other DNA
tttcgcggagagtcgccgtctccaaggtga

SEQ ID NO: 1524 - DNA, 20 bp, synthetic construct
  source 1..20: mol_type = other DNA
tttcgccgtctccaaggtga

SEQ ID NO: 1525 - DNA, 46 bp, synthetic construct
  source 1..46: mol_type = other DNA
tttcgcggatgttccaatacgcagagagtcgccgtctccaaggtga

SEQ ID NO: 1526 - DNA, 47 bp, synthetic construct
  source 1..47: mol_type = other DNA
tttcgcggatgttccaagtacgcagagagtcgccgtctccaaggtga

SEQ ID NO: 1527 - DNA, 47 bp, synthetic construct
  source 1..47: mol_type = other DNA
tttcgcggatgttccaattacgcagagagtcgccgtctccaaggtga

SEQ ID NO: 1528 - DNA, 50 bp, synthetic construct
  source 1..50: mol_type = other DNA
ctcaagcactacctacgtcagcacctgggaccccgccaccgtgcgccggg

SEQ ID NO: 1529 - DNA, 50 bp, synthetic construct
  source 1..50: mol_type = other DNA
ctcaagcactacctacgtcaggtgctgggaccccgccaccgtgcgccggg

SEQ ID NO: 1530 - DNA, 47 bp, synthetic construct
  source 1..47: mol_type = other DNA
ctcaagcactacctacgtcacctgggaccccgccaccgtgcgccggg

SEQ ID NO: 1531 - DNA, 47 bp, synthetic construct
  source 1..47: mol_type = other DNA
ctcaagcactacctacgtcaggtgggaccccgccaccgtgcgccggg

SEQ ID NO: 1532 - DNA, 47 bp, synthetic construct
  source 1..47: mol_type = other DNA
ctcaagcactacctacgtcagctgggaccccgccaccgtgcgccggg

SEQ ID NO: 1533 - DNA, 44 bp, synthetic construct
  source 1..44: mol_type = other DNA
ctcaagcactacctacgtctgggaccccgccaccgtgcgccggg

SEQ ID NO: 1534 - DNA, 50 bp, synthetic construct
  source 1..50: mol_type = other DNA
ctctggtgaagaagttgaagctgtcaggtcctggtggtacaagcactgtt

SEQ ID NO: 1535 - DNA, 46 bp, synthetic construct
  source 1..46: mol_type = other DNA
ctctggtcaagaagttgaagcaggtcctggtggtacaagcactgtt

SEQ ID NO: 1536 - DNA, 47 bp, synthetic construct
  source 1..47: mol_type = other DNA
ctctggtgaagaagttgaagccaggtcctggtggtacaagcactgtt

SEQ ID NO: 1537 - DNA, 47 bp, synthetic construct
  source 1..47: mol_type = other DNA
ctctggtgaagaagttgctgtcaggtcctggtggtacaagcactgtt

SEQ ID NO: 1538 - DNA, 56 bp, synthetic construct
  source 1..56: mol_type = other DNA
ctctggtgaagaagttgaagctgtcactgtcaggtcctggtggtacaagcactgtt

SEQ ID NO: 1539 - DNA, 48 bp, synthetic construct
  source 1..48: mol_type = other DNA
ctctggtgaagaagttgactgtcaggtcctggtggtacaagcactgtt

SEQ ID NO: 1540 - DNA, 50 bp, synthetic construct
  source 1..50: mol_type = other DNA
ctctgggactcaggcgggtcacctacccacgttcgtggccccatctttct

SEQ ID NO: 1541 - DNA, 46 bp, synthetic construct
  source 1..46: mol_type = other DNA
ctctgggactcaggcgggtcacctacccacgtggccccatctttct

SEQ ID NO: 1542 - DNA, 47 bp, synthetic construct
  source 1..47: mol_type = other DNA
ctctgggactcaggcgggtcacctaccgttcgtggccccatctttct

SEQ ID NO: 1543 - DNA, 54 bp, synthetic construct
  source 1..54: mol_type = other DNA
ctctgggactcaggcgggtcacctacccacgttcgttcgtggccccatctttct

SEQ ID NO: 1544 - DNA, 48 bp, synthetic construct
  source 1..48: mol_type = other DNA
ctctgggactcaggcgggtcacctacacgttcgtggccccatctttct

SEQ ID NO: 1545 - DNA, 57 bp, synthetic construct
  source 1..57: mol_type = other DNA
ctctgggactcaggcgggtcacctacccacgttcgacgttcgtggccccatctttct

SEQ ID NO: 1546 - protein, 1277 aa, synthetic construct
MLNLNYYLFYFVSLWQDNEYLKPITMNNLKQFIGIYPVSKTLRFELRPIGKTQEWIEINKVLEGDVQKAADYPTVKKLIDEYHKICIHDSLKNVHFDWAPLKEAIVIFQKTKSDESKKRLEAEQTIMRKQIAAAIKDFKHFKELTAATPSDLITSVLPEFSDDDSLMSFRGFATYFSGFQENRINIYSQESISTGVPYRIVHDNFPKFLSNQEVYDRIRSVCPEVIKQASEELQPFLEGVMIDDIFSLDFYNSLLTQDGIDFYNRVIGGVSEEGKQKYRGINEFSNLYRQQHKDLAASKKAMTMIPLFKQILSDRETLSYIPVQIESEDELVSSIKQFYEHITHFERDGKTVNVLSELVAVLGNIDSYNPDGICISASKLTDISQKVYGKWSIIEEKLKEKAIMQYGDISVAKNKKKVDAYLSRKAYCLSDLCFDEVVSFSRYYSELPQMLNAINGYWMQFNEWCRSDEKQKFLNNPMGTEVVKCLLDAMMELYHKSAVLVMPEEYEVDKSFYNEFIPLYEELDTLFLLYNKVRNYLTRKPSDVKKFKLNFESPSLASGWDQNKEMKNNAILLFKDGKSYLGVLNAKNKAKIKDAKGDASSSSYKKMIYKLLSDPSKDLPHKLFAKGNLDFYKPSEYILEGRELGKYKKGPNFDKKFLHDFIDFYKAAIAIDPDWSKFNFQYSPTESYEDIGAFFSEIKKQAYKIRFTDITESQVNEWVDNGQLYLFQLYNKDYAEGAHGRKNLHTLYWENLFTDENLSNLVLKLNGQAELFCRPQSIKKPVSHKIGSKMLNRRDKSGMPIPENIYRSLYQFYNGKKKESELTTAEKQYMDQVIVKDVTHEIIKYNPDVNIIGIDRGERHLIYLTLINQRGEIIKQKTFNIVNNYNYQVKLEQREDRRYTRQEYFFHVPLTLNANADGNEYINEQVLNYLKKERDEARKSWDSVGKIKDLKEGFLSAVIHEITKMMIENNAIVVLEDLNFGFKRGRFKVERQVYQKFEKMLIDKLNYLSFKDREVGEEGGILRGYQMAQKFVSFQRLGKQSGFLFYIPAAYTSKIDPVTGFVNHFNFNDITNAEKRKDFLMKMERIEMKNGYIEFTFDYRKFKTYQTDYQNVWTVSTFGKRIVMRIDEKGYKKMVDYEPTNDIIYAFKNKGILLSEGSDLKALIADVEANATNAGFFGTLLYAFQKTLQMRNSNALTEEDFILSPVAKDGHHFCSTDEANKGRDAQGNWVSRLPVDADANGAYHIALKGLYLLRNPETKKIENEKWFQFMVEKPYLE

SEQ ID NO: 1547 - DNA, 23 bp, synthetic construct
  source 1..23: mol_type = other DNA
acctcggtgcagagatgcctcgg

SEQ ID NO: 1548 - protein, 8 aa, synthetic construct
VSRKRPRP

SEQ ID NO: 1549 - DNA, 33 bp, synthetic construct
  source 1..33: mol_type = other DNA
gccaacatgaggatcacccatgtctgcagggcc

SEQ ID NO: 1550 - protein, 7 aa, synthetic construct
PKKKRKV

SEQ ID NO: 1551 - protein, 6 aa, synthetic construct
QRKRKQ

SEQ ID NO: 1552 - protein, 6 aa, synthetic construct
GGSGGS

SEQ ID NO: 1553 - protein, 27 aa, synthetic construct
GGSGGSGGSGGSGGSGGSGGSGGSGGS

SEQ ID NO: 1554 - protein, 9 aa, synthetic construct
GGSGGSGGS

SEQ ID NO: 1555 - protein, 12 aa, synthetic construct
GGSGGSGGSGGS

SEQ ID NO: 1556 - protein, 15 aa, synthetic construct
GGSGGSGGSGGSGGS

SEQ ID NO: 1557 - protein, 18 aa, synthetic construct
GGSGGSGGSGGSGGSGGS

SEQ ID NO: 1558 - protein, 21 aa, synthetic construct
GGSGGSGGSGGSGGSGGSGGS

SEQ ID NO: 1559 - protein, 24 aa, synthetic construct
GGSGGSGGSGGSGGSGGSGGSGGS
